United States Patent 7,745,391 (HUMAN THROMBOSPONDIN POLYPEPTIDE) - sequence listing, part 268

SEQ ID NO: 772507 - protein, 1190 aa, Homo sapiens
HEAAQGTGVRAGVRAGTTQSGRRRARVSGRLAEVSMASVAWAVLKVLLLLPTQTWRPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGETAAWTVVQHGGPDAVTLRGAPSGHPRSAVSFAYAAGAGQLRSAVNLAERCEQRLALRCGTARRPDSRDGTPLSWWVGRTNETHTYWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 772508 - protein, 1162 aa, Homo sapiens
HEAAQGTGVRAGVRAGTTQSGRRRARVSGRLAEVSMASVAWAVLKVLLLLPTQTWRPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNDDRDAAWTVVQHGGPDAVTLRGAPSGHPRSAVSFAYAAGAGQLRSAVNLAERCEQRLALRCGTARRPDSRDGTPLSWWVGRTNETHTYWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVIPQMQKSN

SEQ ID NO: 772509 - protein, 1162 aa, Homo sapiens; identical to SEQ ID NO: 772508

SEQ ID NO: 772510 - protein, 31 aa, Homo sapiens
ITDFIRIELRGKLATLDKSQGTHYLAIKALT

SEQ ID NO: 772511 - protein, 1162 aa, Homo sapiens; identical to SEQ ID NO: 772508

SEQ ID NO: 772512 - protein, 746 aa, Homo sapiens
MASVAWAVLKVLLLLPTQTWRPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCKYDRDAAWTVVQHGGPDAVTLRGAPSGHPRSAVSFAYAAGAGQLRSAVNLAERCEQRLALRCGTARRPDSRDGTPLSWWVGRTNETHTYWGGSLPDAQKCTCGLEGNCIDSQYYCNCDAGRNEW

SEQ ID NO: 772513 - protein, 107 aa, Homo sapiens
RDRERELEIRQEKKGNSSTGNICDPTKETNENMVNLRGMQIKTRSYVSPITLASFCKDDIIKIIIGGAGRMWRNRALSDVADVNGSGGSFSVSAFTGGCPLIQQFHM

SEQ ID NO: 772514 - protein, 1529 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 772515 - protein, 101 aa, Homo sapiens
GRAGSTHASGSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 772516 - protein, 1521 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 772517 - protein, 1521 aa, Homo sapiens; identical to SEQ ID NO: 772516

SEQ ID NO: 772518 - protein, 142 aa, Homo sapiens
MLPDHLRSPLDHHRCPTSGDSQVEDPQPHEDTLAGRSVLVKNLNPQTLQPRWTRPYLVICSTLTAVCLQDLPHWVHHSRIKLCPSGSQPNPSLPPGSHKYSPLLPLNSLIFLKNSNNPYEPNTSLYSIRSLHPYPTFCSTAL

SEQ ID NO: 772519 - protein, 26 aa, Homo sapiens [sequence omitted]

SEQ ID NO: 772520 - protein, 50 aa, Homo sapiens [sequence omitted]

SEQ ID NO: 772521 - protein, 329 aa, Homo sapiens [sequence omitted]

SEQ ID NO: 772522 - protein, 329 aa, Homo sapiens [sequence omitted]

SEQ ID NO: 772523 - protein, 161 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLETGGAVSSWCHHWLCCGTLEPVQGGVQHPK

SEQ ID NO: 772524 - protein, 329 aa, Homo sapiens [sequence omitted]

SEQ ID NO: 772525 - protein, 329 aa, Homo sapiens [sequence omitted]

SEQ ID NO: 772526 - protein, 329 aa, Homo sapiens [sequence omitted]

SEQ ID NO: 772527 - protein, 81 aa, Homo sapiens
RSRGGRRHRPRGGRRCRPSTADSAGKMSTEGGGRRCQAQVSRRISFSASHRLYSKFLSDEENLKLFGKCNNPNGHGHNYKD

SEQ ID NO: 772528 - protein, 171 aa, Homo sapiens
RSRGGRRHRPRGGRRCRPSTADSAGKMSTEGGGRRCQAQVSRRISFSASHRLYSKFLSDEENLKLFGKCNNPNGHGHNYKVVVTVHGEIDPATGMVMNLADLKKYMEEAIMQPLDHKNLDMDVPYFADVVSTTENVAVYIWDNLQKVLPVGVLYKVKVYETDNNIVVYKGE

SEQ ID NO: 772529 - protein, 92 aa, Homo sapiens
RSRGGRRHRPRGGRRCRPSTADSAGKMSTEGGGRRCQAQVSRRISFSASHRLYSKFLSDEENLKLFGKCNNPNGHGHNYKGERKTDDISALQ

SEQ ID NO: 772530 - protein, 118 aa, Homo sapiens
RSRGGRRHRPRGGRRCRPSTADSAGKMSTEGGGRRCQAQVSRRISFSASHRLYSKFLSDEENLKLFGKCNNPNGHGHNYKVVRTHCALECLFIEIIVRPVINLSLFKTKLVIYILKII

SEQ ID NO: 772531 - protein, 171 aa, Homo sapiens; identical to SEQ ID NO: 772528

SEQ ID NO: 772532 - protein, 171 aa, Homo sapiens; identical to SEQ ID NO: 772528

SEQ ID NO: 772533 - protein, 87 aa, Homo sapiens
RSRGGRRHRPRGGRRCRPSTADSAGKMSTEGGGRRCQAQVSRRISFSASHRLYSKFLSDEENLKLFGKCNNPNGHGHNYKGGDYAAP

SEQ ID NO: 772534 - protein, 81 aa, Homo sapiens; identical to SEQ ID NO: 772527

SEQ ID NO: 772535 - protein, 171 aa, Homo sapiens; identical to SEQ ID NO: 772528

SEQ ID NO: 772536 - protein, 116 aa, Homo sapiens
MRAKSICTWSHHHWCPGLALTNADSNITVEHPDVAAVPRCRRVILQVPRLTPCCAGPGMTWPQMAALAPSKTGLSRWAGRWLPPPMTELYQAPPIMIWAGRALGNHEETQEASGKM

SEQ ID NO: 772537 - protein, 196 aa, Homo sapiens
TASPSPSKRPVRRPWTQTPEMKPLLLAVSLGLIAALQAHHLLASDEEIQDVSGTWYLKAMTVDREFPEMNLESVTPMTLTTLEGGNLEAKVTMLISGRCQEVKAVLEKTDEPGKYTADGGKHVAYIIRSHVKDHYIFYCEGELHGKPVRGVKLVGRDPKNNLEALEDFEKAAGARGLSTESILIPRQSETCSPGSD

SEQ ID NO: 772538 - protein, 54 aa, Homo sapiens
MLGWADERICVVEPSNVREKDVEDLFYKYGRIRKIKLKNGHCLVPFALVRFEDP

SEQ ID NO: 772539 - protein, 452 aa, Homo sapiens
RSAPNPQRHLRSQLGRLCESNEGHQCGETLSQTANLLVHKSYPTEAKPSECTKCGKAFENRQRSHTGQRPCKECGQACSCLSCQSPPMKTQTVEKPCNCQDSRTASVTYVKSLSSKKSYECQKCGKAFICPSSFRGHVNSHHGQKTHACKVCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVKTHSGVKPYQCKECGKAYSFSSSLRIHVRTHTGEKPFECKHCGKAFSCHSSLREHVRTHSGEKPYECNQCGKAFSHAQYFQKHVRSHSGVKPYECTECGKAYSCSSSLRVHVRTHTGERPYECKQCGKTFRYLASLQAHVRTHAGA

SEQ ID NO: 772540 - protein, 315 aa, Homo sapiens
RSAPNPQRHLRSQLGRLCESNEGHQCGETLSQTANLLVHKSYPTEAKPSECTKCGKAFENRQRSHTGQRPCKECGQACSCLSCQSPPMKTQTVEKPCNCQDSRTASVTYVKSLSSKKSYECQKCGKAFICPSSFRGHVNSHHGQKTHACKVCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVIFPPPFEST

SEQ ID NO: 772541 - protein, 104 aa, Homo sapiens
AGIRVGKGGSRPTGRALRPRRGKGRMADRAQTPGSLPLGFSAGVSSSMIWHLLFGIMCQAGGGPGLNTRPCSSQVKRLIVSCRRILLKGTQAPRREGTVLKVTS

SEQ ID NO: 772542 - protein, 343 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772543 - protein, 343 aa, Homo sapiens; identical to SEQ ID NO: 772542

SEQ ID NO: 772544 - protein, 343 aa, Homo sapiens; identical to SEQ ID NO: 772542

SEQ ID NO: 772545 - protein, 256 aa, Homo sapiens
MKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772546 - protein, 380 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGEWERELPPAPEPAPRVHLCSEWKYLSQQLQCPQLSRGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772547 - protein, 343 aa, Homo sapiens; identical to SEQ ID NO: 772542

SEQ ID NO: 772548 - protein, 257 aa, Homo sapiens
RGFEKCLVTGCDLDVGLIGKIDSKGSCVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772549 - protein, 163 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISPEIISYRDFKKTSLY

SEQ ID NO: 772550 - protein, 110 aa, Homo sapiens
AGTVGDFGSRFACRSVRVAEAAGRRSAGGGASRKTLRQRPPSALPAGERAPARRRVKARASASPLQRSPLPIWFWNHREELGHSNTRCYHAGHPPLQTPVTAPRKNPKCL

SEQ ID NO: 772551 - protein, 83 aa, Homo sapiens
AGTVGDFGSRFACRSVRVAEAAGRRSAGGGASRKTLRQRPPSALPAGERAPARRRVKARASASPLQRSPLPIWFWPVSLEICL

SEQ ID NO: 772552 - protein, 110 aa, Homo sapiens; identical to SEQ ID NO: 772550

SEQ ID NO: 772553 - protein, 74 aa, Homo sapiens
KAQIHTDSCLASHFSPRVFTPNYHRIGLDLVFESVACCPLHCALLLLTHLSSPVLPGTARFPGKTRGADADAWA

SEQ ID NO: 772554 - protein, 150 aa, Homo sapiens
LSQDKPLVGAPARIQYPGPRSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTASSSPWGGSGCRGVDAAANLVVVGGRSR

SEQ ID NO: 772555 - protein, 343 aa, Homo sapiens; identical to SEQ ID NO: 772542

SEQ ID NO: 772556 - protein, 343 aa, Homo sapiens; identical to SEQ ID NO: 772542

SEQ ID NO: 772557 - protein, 256 aa, Homo sapiens; identical to SEQ ID NO: 772545

SEQ ID NO: 772558 - protein, 324 aa, Homo sapiens
MASNGIQKRRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772559 - protein, 335 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTASSSPWGGSGCRGVDAAANLVVVGGRSR

SEQ ID NO: 772560 - protein, 206 aa, Homo sapiens
MWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 772561 - protein, 162 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLERGL

SEQ ID NO: 772562 - protein, 108 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKTAMMGQELTANSTIRSAHV

SEQ ID NO: 772563 - protein, 110 aa, Homo sapiens; identical to SEQ ID NO: 772550

SEQ ID NO: 772564 - protein, 574 aa, Homo sapiens
RSRAEEASQGHAGEAGRPARGAPASGALSGASARAPMVTCAHLGRRARLPAAQPSACPGTCFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQEEPASGINMIKLIREDGGWKQLEDSHEDPQGLLSQKASLHVVAVPQEKATAWHGFGENGNLSPALVLSQGSSKGNHLCGSELDITSLASDSVLNHHQLGYADRRPCESNECGNAIRQNSHFIQHGGKMFVYLENGQSLNHGMALTIHNKINTAEKPFECHQCGKVFNRRHSLSEHQRIHTGEKPYECQECGRAFTHSSTLTRHLRTHTGEKPYGCGECGKAFNRISSLTQHQRIHTGEKPYKCEDCGKSFCQSSYLILHKRTHTGEKPYECSECGKAFSDRSSLNQHERTHTGENPYECKQCGRAFSQRSSLVRHERTHTGEKPYRCQECGKAFSQSSSLVTHQKTHSSQKTYKIIDCGKAFYQNRHLIGY

SEQ ID NO: 772565 - protein, 120 aa, Homo sapiens
NIALEVDAFGTRNGTDDPSYNGAITVCCNEKNYSFSLACNAKRLNCFPVLMDIVSNGLLGMVKPSVHIRTERSTFLEVNIYNLTIPDSPLSGISQITLLSAGILFLLSKPLHNKLTFGLI

SEQ ID NO: 772566 - protein, 536 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTGTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 772567 - protein, 554 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 772568 - protein, 472 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTGTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREV

SEQ ID NO: 772569 - protein, 324 aa, Homo sapiens
PSLERRAAAAEPDVSAKMAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFA

SEQ ID NO: 772570 - protein, 210 aa, Homo sapiens
PSLERRAAAAEPDVSAKMAGRVVNMLKASCYMDPQVVLGANSGLHIIIFDEIDAICKQRGSMAGSTGVHDTVVNQLLSKIDGMEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVMRGDFLASLENDI

SEQ ID NO: 772571 - protein, 171 aa, Homo sapiens
PSLERRAAAAEPDVSAKMAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAARPLSSHELLTQGRAAKPGYRNLNLPMIACPSKAVL

SEQ ID NO: 772572 - protein, 175 aa, Homo sapiens
GTEVSGSRPFPFSSPLESSLPRLPRLPALRRAGVLVPYRQSPAARSRDALFLLWVLIMETKRVEIPGSVLDDLCSRFILHIPSEERDNAIRVCFQIELAHWFYLDFYMQNTPGLPQCGIRDFAKAVFSHCPFLLPQGEDVERVWMNGRNIKWEYQHMVQLFLMRHLKMYYWFRGT

SEQ ID NO: 772573 - protein, 86 aa, Homo sapiens
GTEVSGSRPFPFSSPLESSLPRLPRLPALRRAGVLVPYRQSPAARSRDALFLLWVLIMETKRVEIPGSVLDDLCRICEDYFMKTRK

SEQ ID NO: 772574 - protein, 104 aa, Homo sapiens
APLCLLSVSLADLTTSSSLVPSAFMLSQQKEHCIVTWSQHATCPITSMQLEDSAAVTQADVTACPPLSALVPPRPQGCTERHCAGFQTTSLTGKGHVQSWPPCS

SEQ ID NO: 772575 - protein, 130 aa, Homo sapiens
PKVTGGQCPRSQGGYGFPTQSPGRPHLGTPTRSQQLRGAQGGVLGPRGPGCKETACLQGPLGEPLPPRPPPVSQEAPKSMRPHLGMRPRQGWEGCRSWEAPGQLQPFRRSLWPQNSGKSKKESKCLAFGD

SEQ ID NO: 772576 - protein, 37 aa, Homo sapiens
MRKKKKDKRKKKREKEEERRRRKKEKEKRKEEEKEEE

SEQ ID NO: 772577 - protein, 152 aa, Homo sapiens
CLEDPVDGTNTIHHIHGKTWSFVCVLKQSSQGSLCPWQKIDSKLAPREDTIQGFNIPGYSPLCLEMRCLFPPLRFCWSCVLLSGACVTIRQRQEGLHRSAATGSEQSKQHCKQLKLGPAQRTSQPLGTLLTSSSTLAWLRTVRSPPMWRQWV

SEQ ID NO: 772578 - protein, 188 aa, Homo sapiens
KFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 772579 - protein, 135 aa, Homo sapiens
MFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 772580 - protein, 123 aa, Homo sapiens
FSFSTTEGVSEQDGGSTLQRAAVSREDSGTYVCWAENRVGRTQAVSFVHVKEAPVLQGEAFSYLVEPVGGSIQLDCVVRGDPVPDIHWIKDGLPLRGSHLRHQLQNGSLTIRRTEARRGLAPW

SEQ ID NO: 772581 - protein, 151 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKGGHWLMPY

SEQ ID NO: 772582 - protein, 728 aa, Homo sapiens
MMDASKELRSHFVAQAACCGYFTAAIIAHCSLKLLGSSDSPTSVSRVTGIQLQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 772583 - protein, 622 aa, Homo sapiens
MGVPNEQSCVPARTGVSPAAGAEPAPTILPPTETGIQHSTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 772584 - protein, 73 aa, Homo sapiens
CREFRNGDVKFSLESLGISSLQTSDHGTVQPGETIQSQIKCTPIKTGPKKFIVKLSSKQVKEINAQKIVLITK

SEQ ID NO: 772585 - protein, 411 aa, Homo sapiens
MGVPNEQSCVPARTGVSPAAGAEPAPTILPPTETGIQHSTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGASITGLLLTQPLSHPEHENSQDWGWTWATW

SEQ ID NO: 772586 - protein, 684 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 772587 - protein, 622 aa, Homo sapiens; identical to SEQ ID NO: 772583

SEQ ID NO: 772588 - protein, 285 aa, Homo sapiens
MVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 772589 - protein, 622 aa, Homo sapiens; identical to SEQ ID NO: 772583

SEQ ID NO: 772590 - protein, 622 aa, Homo sapiens; identical to SEQ ID NO: 772583

SEQ ID NO: 772591 - protein, 118 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVSTHWAGGWAGWLLAECS

SEQ ID NO: 772592 - protein, 353 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEFIEEEDQEEEESTEGKEEGHQ

SEQ ID NO: 772593 - protein, 346 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTAEDDEDDDVDTKKQKTDEDD

SEQ ID NO: 772594 - protein, 188 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSPGWEGSGPLEGQWGGDVFSLLREQGLG

SEQ ID NO: 772595 - protein, 37 aa, Homo sapiens
MTPPQTGPSRIGTRACTLQEPQTSAVLETERVPERGD

SEQ ID NO: 772596 - protein, 445 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 772597 - protein, 453 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWKKMKKKTCL

SEQ ID NO: 772598 - protein, 365 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 772599 - protein, 62 aa, Homo sapiens
SDFQPLLHPPHSQLVPVFPFTEKKEASEELPEPPTTPSACQQLIPFLQMSYLCSRLQPAVPP

SEQ ID NO: 772600 - protein, 165 aa, Homo sapiens
MTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTF

SEQ ID NO: 772601 - protein, 252 aa, Homo sapiens
AERPGLCLPKPAPPQASPAHLQSALLSPLYINECTQDPPSVFHAAARVPPKQTSSQDSVARPSQPPARLSLPTHQQQDSQAISIPPKSPVPPAPRLLFTCRAVPASAHPLILQIWSSIPGPAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 772602 - protein, 192 aa, Homo sapiens
AAAASHRSRARSRPRRVSSGPAPRRAQSSAGRVASGLDSAPLCTMARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 772603 - protein, 192 aa, Homo sapiens; identical to SEQ ID NO: 772602

SEQ ID NO: 772604 - protein, 126 aa, Homo sapiens
MTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 772605 - protein, 168 aa, Homo sapiens
AAAASHRSRARSRPRRVSSGPAPRRAQSSAGRVASGLDSAPLCTMARALCRLPRRGLWLLLAHHLFMTTACQEANYGALLRELCLTQFQVDMEAVGETLWCDWGRTIRSYRELADCTWHMAEKLGCFWPNAEVDRFFLAVHGPSGALGQSRPTMPPFFQPRRAHRSPE

SEQ ID NO: 772606 - protein, 140 aa, Homo sapiens
GERAFWKAWAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 772607 - protein, 218 aa, Homo sapiens
SSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTRSEITKNLDVKGSENSLPGAGSSGNFDRDTISSEYTHSSASSPELNDSSVALSSWGQQPSSGYQEENQGNWSEQNHQESELITTDGQVEIVTKVKD

SEQ ID NO: 772608 - protein, 125 aa, Homo sapiens
ILPNTQPGYLTFLQQTLSGSLLPRKRPPAPLPLLWSCACPSPASSLPHHLPLLVSNAICLWLSKAQGRPLPVCMEKSCQAPCHLPSHGHLGELLLAATYVGCLDAHRAMTEPVRRKYLNPCIPHP

SEQ ID NO: 772609 - protein, 72 aa, Homo sapiens
GNSRTVAEARLLCFSRSRLCAWGLHRPTLAAAAAALLAQEAIRMKQENRSNPGDGGCSEPRSCHCIPAWATE

SEQ ID NO: 772610 - protein, 95 aa, Homo sapiens
PAAPSPSPGCVSLPMTRSWGPPARPGTFLPNPQTHDSLPHRLPQRPPTHFILSGHPSDLDPPVRAFKAPNSGTRSAPLPRPRAGNFSLPDPALLF

SEQ ID NO: 772611 - protein, 149 aa, Homo sapiens
MYVSTQMSNICITRRKGEREPSGTCCTRHIICYCPCFPDEARYSSMKLNDWFSVNTASERQRWNLNAHLSDSTSCSFHMASKLCCPTSHFWEVATPSFHPLFWILTRDSTLPQLSKPAAAAKKPQHRHTLDLHHVLMSQMLYQAFDSLI

SEQ ID NO: 772612 - protein, 104 aa, Homo sapiens
MKLNDWFSVNTASERQRWNLNAHLSDSTSCSFHMASKLCCPTSHFWEVATPSFHPLFWILTRDSTLPQLSKPAAAAKKPQHRHTLDLHHVLMSQMLYQAFDSLI

SEQ ID NO: 772613 - protein, 56 aa, Homo sapiens
MLHLPSNYEVGTTDIHKEPEPECGSDVPAPPSQETTESNPRLRPTPLLIATCHTTR

SEQ ID NO: 772614 - protein, 1301 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRSLALSPRLEYSGAILAHCKLRLPGSCHSPASASQVAGTTGAHHHARLIFAFLVEMEFHHVSQAGLELLTSGDLPTSASQVLGLQAVSHRAWPRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 772615 - protein, 150 aa, Homo sapiens
SDFLCVLWVQTEILPYGTELSHYRQRALLQSQPVRRTPLLHNFLHMLSSRSSGIQAVSREVPATEKEVHWQSGLMPDVANKLREGVAWLAFSTTEPFLFAYFLIPLSPCIFLSFPSLNVESRTRSVKGQPFTFLLLNEPFFCLVTKCPEL

SEQ ID NO: 772616 - protein, 1053 aa, Homo sapiens
MLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 772617 - protein, 1024 aa, Homo sapiens
MLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 772618 - protein, 855 aa, Homo sapiens
MLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETHQRELQVRARFYR

SEQ ID NO: 772619 - protein, 76 aa, Homo sapiens
LPPLERTEGQTPSSSRLELSSSASPQEERTVGVAFNQETGHWERIYTQSSRSGTVSQEALHQDMPEESSEEDSLRR

SEQ ID NO: 772620 - protein, 1238 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 772621 - protein, 1024 aa, Homo sapiens; identical to SEQ ID NO: 772617

SEQ ID NO: 772622 - protein, 1024 aa, Homo sapiens; identical to SEQ ID NO: 772617

SEQ ID NO: 772623 - protein, 577 aa, Homo sapiens
MLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGKEMFLWLLKM

SEQ ID NO: 772624 - protein, 223 aa, Homo sapiens
SARRKQSGAPVPWFLRAMARGGWRRLRRLLSAGQLLFQGRALLVTNTLGCGALMAAGDGVRQSWEIRARPGQVFDPRRSASMFAVGCSMGPFLHYWYLSLDRLFPASGLRGFPNVLKKVLVDQLVASPLLGVWYFLGLGCLEGQTVGESCQELREKFWEFYKADWCVWPAAQFVNFLFVPPQFRVTYINGLTLGWDTYLSYLKYRSPVPLTPPGCVALDTRAD

SEQ ID NO: 772625 - protein, 223 aa, Homo sapiens; identical to SEQ ID NO: 772624

SEQ ID NO: 772626 - protein, 223 aa, Homo sapiens; identical to SEQ ID NO: 772624

SEQ ID NO: 772627 - protein, 329 aa, Homo sapiens
SARRKQSGAPVPWFLRAMARGGWRRLRRLLSAGQLLFQGRALLVTNTLGCGALMAAGDGVRQSWEIRARPGQVFDPRRSASMFAVGCSMGPFLHYWYLSLDRLFPASGLRGFPNVLKKVLVDQLVASPLLGVWYFLGRLVRVACCAVRELPLRAPPISSHLHQRPDAGLGHVPVLLEVPEPSSSDTPRLCGPGHPSRLNCLLPGPDARLSPGGPPPLTEGEWAPAASSGLEPRPSTTSAPEHWAEPPFPSSLLGLSFLNRNTPMKMDDHPLALLSRNLMRPVTKMSHPQHRAHSANQSQAPAPQHCHPPGSGPSHQSRAPSGPGTKAGT

SEQ ID NO: 772628 - protein, 128 aa, Homo sapiens
SARRKQSGAPVPWFLRAMARGGWRRLRRLLSAGQLLFQGRALLVTNTLGCGALMAAGDGVRQSWEIRARPGQVFDPRRSAVTKMSHPQHRAHSANQSQAPAPQHCHPPGSGPSHQSRAPSGPGTKAGT

SEQ ID NO: 772629 - protein, 193 aa, Homo sapiens
MHGWALPVFPVRLRLRDGIGLTQALAREGEREWTEELAGRPSPLTYTLIASMFAVGCSMGPFLHYWYLSLDRLFPASGLRGFPNVLKKVLVDQLVASPLLGVWYFLGLGCLEGQTVGESCQELREKFWEFYKADWCVWPAAQFVNFLFVPPQFRVTYINGLTLGWDTYLSYLKYRSPVPLTPPGCVALDTRAD

SEQ ID NO: 772630 - protein, 49 aa, Homo sapiens
MWLFVKLCCCLWPTAQDSQAGMAVFLLPSWCVVEFVDSVLCRTLFWKNP

SEQ ID NO: 772631 - protein, 126 aa, Homo sapiens
MANEALGISTASCWRSQRTGDSAGMGESEGLTECPILTSSCTFQRDGLQGVIEWMNMTRGTQSSPQQLLEDSISGPLNPPHQHMHTCTDLQGPDPGGPGDTASRGCLAMSLPRSAWIHARPPSTIC

SEQ ID NO: 772632 - protein, 104 aa, Homo sapiens
MSSAARSRLTRATRQEMLFLALLLLPVVVAFARAEAEEDGDLQCLCVKTTSQVRPRHITSLEVIKAGPHCPTAQLIATLKNGRKICLDLQALLYKKIIKEHLES

SEQ ID NO: 772633 - protein, 649 aa, Homo sapiens [sequence omitted]

SEQ ID NO: 772634 - protein, 175 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRDPRPWSKEGPNQYLPQITWTV

SEQ ID NO: 772635 - protein, 199 aa, Homo sapiens
ISGTDYTCALAALGRTPWSPAFLLTVHLEPALSLLQIDATSLIAASVMAAPCALALSKLVYPEVEESKFRREEGVKLTYGEHSRRSCRQGSGTRWGEQSRGSRSLCPSLSSTSLGPSLHFSCSGLGFICCLSPFSVAYNRNPETGYFIKNKNLFLTVMEAEKSKVEGLYLARAFLLLGILQSPKLAQGITWRGVEGCQA

SEQ ID NO: 772636 - protein, 649 aa, Homo sapiens [sequence omitted]

SEQ ID NO: 772637 - protein, 543 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGNRKQWISRRGLAMLTRLVLNSWP

SEQ ID NO: 772638 - protein, 107 aa, Homo sapiens
MAHWPGANTGQASSLLWKDRPSTCQAFVPNLLHERPSPEDGAAQGPSSRTAGMTASRFPGCCVLGVTWSSRVLPYSTRGLCLHQGGKTVLGATPWAMKRSGQKDSAG

SEQ ID NO: 772639 - protein, 77 aa, Homo sapiens
ALNGVVLAGQNLWGTVCWCAIGGLHQAVVVVAVLAGTDQIEVSDDDLGVSAWMVVEQIVRLEVLVCDAQCMQILDAI

SEQ ID NO: 772640 - protein, 181 aa, Homo sapiens
RCGHCPTPVRLRPLWAAPPQIRIGDNRAFGGGGRSCPRLWVGRRSRNPEPPRGGDSAPAPEPGPGEAGMAPRPPTAAPQESVTFKDVSVDFTQEEWYHVDPAQRSLYRDVMLENYSHLVSLGYQVSKPEVIFKLEQGEEPWISEGEIQRPFYPGFVCLLPLSLPSGSKGERRQKLPRKNPE

SEQ ID NO: 772641 - protein, 115 aa, Homo sapiens
RCGHCPTPVRLRPLWAAPPQIRIGDNRAFGGGGRSCPRLWVGRRSRNPEPPRGGDSDSCPGAGPWRGRNGPEASDRRAPGISDIQRCVCGLHPGRMVPCRPCSEELIQGCDAGEL

SEQ ID NO: 772642 - protein, 237 aa, Homo sapiens
RCGHCPTPVRLRPLWAAPPQIRIGDNRAFGGGGRSCPRLWVGRRSRNPEPPRGGDSAPAPEPGPGEAGMAPRPPTAAPQESVTFKDVSVDFTQEEWYHVDPAQRSLYRDVMLENYSHLVSLGYQVSKPEVIFKLEQGEEPWISEGEIQRPFYPDWKTRPEVKSSHLQQDVSEVSHCTHDLLHATLEDSWDVSSQLDRQQENWKRHLGSEASTQKKIITPQENFEQNKFGENSRLNTN

SEQ ID NO: 772643 - protein, 115 aa, Homo sapiens; identical to SEQ ID NO: 772641

SEQ ID NO: 772644 - protein, 788 aa, Homo sapiens
MALLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 772645 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 772646 - protein, 511 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTDFAGLRNLGSGQRALVLPAAWLSVTCCPPEQGDFVVLELGATGASLRVLWVTLTGIEGHRVEPRSQEFVIPQEVMLGAGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 772647 - protein, 39 aa, Homo sapiens
MALPGIASVVCQAGCCLVSVTETLSNTGLDKVEFSFFPL

SEQ ID NO: 772648 - protein, 180 aa, Homo sapiens
RLVPCVSILELLHLTHAATPGEGAISLMSLAGAQGAERWGNVLKVTQQPGSRPRVALVCPTAASVFVLPHHLPHCELLQGKGRVLFVFAFPRATGIDLRSVLRTHTILGAHSSHHALEAPLSQDSSPQMPTTCRKDASPTASLQGKVSLSLQDSHLRFLCVNHSDSNAPSPLPVVLHWLG

SEQ ID NO: 772649 - protein, 572 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 772650 - protein, 572 aa, Homo sapiens; identical to SEQ ID NO: 772649

SEQ ID NO: 772651 - protein, 572 aa, Homo sapiens; identical to SEQ ID NO: 772649

SEQ ID NO: 772652 - protein, 572 aa, Homo sapiens; identical to SEQ ID NO: 772649

SEQ ID NO: 772653 - protein, 572 aa, Homo sapiens; identical to SEQ ID NO: 772649

SEQ ID NO: 772654 - protein, 136 aa, Homo sapiens
MECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 772655 - protein, 572 aa, Homo sapiens; identical to SEQ ID NO: 772649

SEQ ID NO: 772656 - protein, 572 aa, Homo sapiens; identical to SEQ ID NO: 772649

SEQ ID NO: 772657 - protein, 133 aa, Homo sapiens
LCNLITAHCWLLVFFFFTIRPVKLFSVHMPAEWKESFRISVSSPVILPCAVIIVDFWLRLVSGRISSFVSHCQPPSEAPHSRSHVTRGWVQLLIFRITAWVPWGIFTFRVIDSGYGSFLFSGKNRIFFLSNYF

SEQ ID NO: 772658 - protein, 619 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPGAMWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 772659 - protein, 440 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSRVHILRLQGGFP

SEQ ID NO: 772660 - protein, 572 aa, Homo sapiens; identical to SEQ ID NO: 772649

SEQ ID NO: 772661 - protein, 572 aa, Homo sapiens; identical to SEQ ID NO: 772649

SEQ ID NO: 772662 - protein, 320 aa, Homo sapiens
MPADPGQGFSAQNCLSTSGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 772663 - protein, 158 aa, Homo sapiens
MPKRIRICSTQNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 772664 - protein, 113 aa, Homo sapiens
CDLADLSDQPDSLPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 772665 - protein, 63 aa, Homo sapiens
FFSAHYTNSMLACKNTAWILSGRLLLLCCETTEWGIWLGFWVFCCCCLFVILKVNCTFKKIIG

SEQ ID NO: 772666 - protein, 196 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEALTRLTDNDLTDN

SEQ ID NO: 772667 - protein, 106 aa, Homo sapiens
KRQEFWGAGGSNNSITSGMLRGVHGEDPGLLLPKASSPVVSTGKMAANTLQAVVFLPLKGSAVLKGTVSALPGCCSGTPCCQPTTPPTILSFHPYPPVWTFHNSQP

SEQ ID NO: 772668 - protein, 106 aa, Homo sapiens; identical to SEQ ID NO: 772667

SEQ ID NO: 772669 - protein, 105 aa, Homo sapiens
MGGSSQRPRTTWQEGAFGFRTGMERELIESRNLETPDTEGGRYNRSCQVDFQGFALAVPETYGGLDSPVSTLPYLESCSVTQAGVQWCNLKLTATSVQVQVENLN

SEQ ID NO: 772670 - protein, 462 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 772671 - protein, 358 aa, Homo sapiens
CTQAVCWERYHCLWFLMCKMDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 772672 - protein, 462 aa, Homo sapiens; identical to SEQ ID NO: 772670

SEQ ID NO: 772673 - protein, 268 aa, Homo sapiens
MKSGKQLGSYEISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 772674 - protein, 439 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVDFLQGDCTKAKQKLNWKPRVAFDELVREMVHADVELMRTNPNA

SEQ ID NO: 772675 - protein, 472 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVVRTLWPPSAWPRLAGWLGKCAHGMPGASLWSCQFSSLASFSVHFQNQNTVNSI

SEQ ID NO: 772676 - protein, 351 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVELAPL

SEQ ID NO: 772677 - protein, 177 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQVSAGAGARRPRQPGHACSPYAPLLVGCGLSRNSPLGVPEGVCCREVGRKVRCS

SEQ ID NO: 772678 - protein, 475 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEMVPTWLSSCWRKAVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 772679 - protein, 439 aa, Homo sapiens; identical to SEQ ID NO: 772674

SEQ ID NO: 772680 - protein, 422 aa, Homo sapiens
DANDAAPVRPQPRCLARRARLGRLGPPPALPARPPVRPCQTVAAGRAVRSPSLPAAWRGASCCTPPRSCRHRACPLPRSALPPTARPPRDMAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVETN

SEQ ID NO: 772681 - protein, 148 aa, Homo sapiens
PLSAVDALASGLLLLLFLSLSFLEKILKCPRLSVPGSPAGLVQVEGNSAAGTFCSRGCFPSCSALAQAARSSEASGGRARPPCSPPLGRPPLRTHGAVDHPSVPWVASRDFLGSLISVPESTTPGLEKIALHAPETLDHMMPSLWTDP

SEQ ID NO: 772682 - protein, 59 aa, Homo sapiens
RCVWSQPVCLVGVSPLAGVLRWVESQCPQRRSKPLCLYVSRCLLIQLNSSHLTPPHRSH

SEQ ID NO: 772683 - protein, 67 aa, Homo sapiens
PFPDTHPFSARNGAVGERISRGGWIENGYHLRSPRRPAIGQCLMESSRWRRLKGNSLLPAGPREGGL

SEQ ID NO: 772684 - protein, 248 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 772685 - protein, 180 aa, Homo sapiens
EIYVLIGSGGCIHSSLCPLEALSPALALALAQQPANALRSSPDPCVPLSGPTGWDSPICTEGVVSVSWGENTVMSCNISNAFSHVNIKLRAHGQESAIFNEVAPGYFSRDGWQLQVQGGVAQLVIKGARDSHAGLYMWHLCRASLDPDLFMLLSSSLRRGPLMSSSVWGGKITGNPPSVL

SEQ ID NO: 772686 - protein, 248 aa, Homo sapiens; identical to SEQ ID NO: 772684

SEQ ID NO: 772687 - protein, 219 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRRECRASLDPDLFMLLSSSLRRGPLMSSSVWGGKITGNPPSVL

SEQ ID NO: 772688 - protein, 219 aa, Homo sapiens; identical to SEQ ID NO: 772687

SEQ ID NO: 772689 - protein, 248 aa, Homo sapiens; identical to SEQ ID NO: 772684

SEQ ID NO: 772690 - protein, 73 aa, Homo sapiens
DEGHVANRNMKGETRKGFHPCDMHGPAQPPMWTLCLSVSASLSLFSLTHMHAHMHTCPCAHTCSRIPQLPLAV

SEQ ID NO: 772691 - protein, 110 aa, Homo sapiens
MCLVFVAFATWAVRTSDPHTPDAWKTALLANVGTISAIRYFRRQRGKGAAATAPAPAPRSQARAREMQDEETTTGAQGRTRCRPRPGPLTPLFYRVQEGGVSWCCSLRLT

SEQ ID NO: 772692 - protein, 38 aa, Homo sapiens
QQLASLRTPGSQENCSSLTSRQTGLKVSGVLGVVGGAF

SEQ ID NO: 772693 - protein, 490 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 772694 - protein, 89 aa, Homo sapiens
ATDNAVVAENVEDDLHLRLVNEVHEVDDTIQTLQQRLRDAEDTLQSLVHIKATLEYDLAVKANSLYIDQEKCMSMRKSYPNTLRLVGFC

SEQ ID NO: 772695 - protein, 490 aa, Homo sapiens; identical to SEQ ID NO: 772693

SEQ ID NO: 772696 - protein, 233 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTVNVGEMHQSQAA

SEQ ID NO: 772697 - protein, 122 aa, Homo sapiens
HSGCMFFKVGSIEPLFMHSSLFRISSSPLQRLHGPLDSQLEAPLCFRRTQHLVNEVHEVDDTIQTLQQRLRDAEDTLQSLVHIKATLEYDLAVKANSLYIDQEKCMSMRKSYPNTLRLVGFC

SEQ ID NO: 772698 - protein, 324 aa, Homo sapiens
MIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 772699 - protein, 643 aa, Homo sapiens
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 772700 - protein, 122 aa, Homo sapiens
QKLAEHLTIPDRKTMYEQWENFNKETENAKKYQTEIMELKNMITALKKSLDEGNSRLDQAEKRISELKERSLEINHRSKRKKRKRVKKVEGTYGTPSIRPIDALRESQKDKGKNHYIQRNNG

SEQ ID NO: 772701 - protein, 91 aa, Homo sapiens
LAWLRQITRNLVALNDTTYSVQFYRLDVWHRSHWANIKVSAGLYSFLEAPGENPFPCLFQLLEEVTFPGSWTPSPSSKPSPVCLPTLTDKL

SEQ ID NO: 772702 - protein, 95 aa, Homo sapiens
MLGASEGRPRDDKKKKDAGNSARKDKDPVNNSGGRAKKKRGSTGKVRDKLNNKVWWDKATYDKFCREVPNYKFITQVVVSERQGRAERQGRAEGD

SEQ ID NO: 772703 - protein, 110 aa, Homo sapiens
LEVLEPFGEDLGDVVSTSYICHSAKGIDRVYVATRHRAGPMDGYFKKADFHSIEGRHFLTIRTIQSGTDCLERHEVSVTGDIQIEARQSLGCHIVEGPLPWGRVIGLNCC

SEQ ID NO: 772704 - protein, 140 aa, Homo sapiens
MYMTMALPKKSPTTQRWEEQVEKAFLRPSPDWILRMAARMCEEETSTRQSGPTRMNMQAAKMTTWLSQVSAQASLRTDRISQKKWLISRGPQKGSLRMRLTWTIARREPHVQEVMARVMQTFQVMMMKYRRGWQMATYRS

SEQ ID NO: 772705 - protein, 221 aa, Homo sapiens
MGGAGRGGSRLSSQHFGRLGQEDRLSPGVRDQPGQHSETVSLHKIKKKVSWALYMCLWSQLLRRLRQEDCLSPGVGCCSEPRSHHCPPLWATEQYPVSENKQQKAETLKGSVYGKTACQNTWLLLPQISGPGNEGWSREAFLQAVATRPAMGTLATEASRGVSQSLDRCADVSGVEGGWGVCKGVCVPGGCSWASMCVPVCVRAPPLQPSVVSPSSPFATF

SEQ ID NO: 772706 - protein, 221 aa, Homo sapiens; identical to SEQ ID NO: 772705

SEQ ID NO: 772707 - protein, 221 aa, Homo sapiens; identical to SEQ ID NO: 772705

SEQ ID NO: 772708 - protein, 221 aa, Homo sapiens; identical to SEQ ID NO: 772705

SEQ ID NO: 772709 - protein, 182 aa, Homo sapiens [sequence omitted]

SEQ ID NO: 772710 - protein, 105 aa, Homo sapiens [sequence omitted]

SEQ ID NO: 772711 - protein, 287 aa, Homo sapiens
FYFRTLFQQHNEAVNVWTHLLAALVLLLRLALFVETVDFWGDPHALPLFIIVLASFTYLSFSALAHLLQAKSEFWHYSFFFLDYVGVAVYQFGSALAHFYYAIEPAWHAQVQAVFLPMAAFLAWLSCIGSCYNKYIQKPGLLGRTCQEVPSVLAYALDISPVVHRIFVSSDPTTDDPALLYHKCQVVFFLLAAAFFSTFMPERWFPGSCHVFGQGHQLFHIFLVLCTLAQLEAVALDYEARRPIYEPLHTHWPHNFSGLFLLTVGSSILTAFLLSQLVQRKLDQKTK

SEQ ID NO: 772712 - protein, 83 aa, Homo sapiens
FYFRTLFQQHNEAVNVWTHLLAALVLLLRLALFVETVDFWGDPHALPLFIIVLASFTYLSFSALAHLLQAKSEFWHYSFFFLD

SEQ ID NO: 772713 - protein, 99 aa, Homo sapiens
EIPHTEYSPPYSLEKMTDLVAVWDVALSDGVHKIEFEHGTTSGKRVVYVDGKEEIRKEWMFKLVGKETFYVGAAKTKATINIDAISGFAYEYTLYGGYW

SEQ ID NO: 772714 - protein, 179 aa, Homo sapiens
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 772715 - protein, 426 aa, Homo sapiens
SALYRIAAHVCNPKVGSVAAGGVASCAGRPRGPERRDKQSARLVLAPAELSTSAPAAPVSRPGEQGHAAYAAESEPTGCLVKPTPEPPAAHRAQSDRISLCHPGLECSGMISAHCNLHLPGSSDSCASASGVAGIYRRALPCPANFSIFAKTGFHRFVQAGLELLTSSDPTALTSQSAGITGCEPSRLATFSKVLNQSLLRQSYDPSSMAILSYAVPFIRTLPLLCYNHLLVSPDSATLSPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 772716 - protein, 120 aa, Homo sapiens
SALYRIAAHVCNPKVGSVAAGGVASCAGRPRGPERRDKQSARLVLAPAELSTSAPAAPVSRPGEQGHAAYAAESEPTGCLVKPTPEPPAAHRAQTDCFCQPWHLEMTVLSLKMMKALLTA

SEQ ID NO: 772717 - protein, 81 aa, Homo sapiens
VRAIVILSSTHTRPPKKDAMDVWCNGKKLETAGEFVDDGTETHFSIGNHDCYIKAVSSGKRKEGIIHTLIVDNREIPEIAS

SEQ ID NO: 772718 - protein, 86 aa, Homo sapiens
MRGGCGLRLRQRTRVGSVAAGGVASCAGRPRGPERRDKQSARLVLAPAELSTSAPAAPVSRPGEQGHAAYAAESEPTGCLVKPTPE

SEQ ID NO: 772719 - protein, 179 aa, Homo sapiens; identical to SEQ ID NO: 772714

SEQ ID NO: 772720 - protein, 199 aa, Homo sapiens
DPPLCLPKCRDYSPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 772721 - protein, 179 aa, Homo sapiens; identical to SEQ ID NO: 772714

SEQ ID NO: 772722 - protein, 175 aa, Homo sapiens
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRARRAWPEERGQKEVAS

SEQ ID NO: 772723 - protein, 307 aa, Homo sapiens
GKPEGCGSCYSQGQAPGNRGHSGVVCSLICNIIVLSCAFPMHYIKTWSLLGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLRKDMERDLKADSNMPLNNSSQEVTKDLLDMIDHTSIRTIEELAGKIEFENELNHMCGHCQDSPFKEEAWALLMDKSPQKATDADPGSLKQAFDDHNIVETVLDLEEDYNVMTSFKYQIE

SEQ ID NO: 772724 - protein, 189 aa, Homo sapiens
GKPEGCGSCYSQGQAPGNRGHSGVVCSLICNIIVLSCAFPMHYIKTWSLLGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLR

SEQ ID NO: 772725 - protein, 553 aa, Homo sapiens
RHFLVSEPGAEAMGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 772726 - protein, 494 aa, Homo sapiens
QPALVFFLRPLLQVLFRLITFVLNAFILRFLSKEIVGVVNVRVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 772727 - protein, 327 aa, Homo sapiens
EAVGLIAEEIVTNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 772728 - protein, 252 aa, Homo sapiens
RHFLVSEPGAEAMGSQEVLGHAARLASSGLLLQVLFRLITFVLNAFILRFLSKEIVGVVNVRVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVDDLFECLGLWDHGGVK

SEQ ID NO: 772729 - protein, 486 aa, Homo sapiens
GGISWCLSLARRLWAARRCWATRPGWPPPVSSCRVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 772730 - protein, 217 aa, Homo sapiens
MSVPHAYDGNENSIVTSELCPRKMLSSRSFRKNNSIFSFSFLSCPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 772731 - protein, 136 aa, Homo sapiens
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCLCVRIADNL

SEQ ID NO: 772732 - protein, 136 aa, Homo sapiens; identical to SEQ ID NO: 772731

SEQ ID NO: 772733 - protein, 136 aa, Homo sapiens; identical to SEQ ID NO: 772731

SEQ ID NO: 772734 - protein, 136 aa, Homo sapiens; identical to SEQ ID NO: 772731

SEQ ID NO: 772735 - protein, 125 aa, Homo sapiens
SRGGRHFLSASPVGLAHRVKPAAANRGARLLPVARPGGRRPPGLGKPFQVPRVAGVTHAPPSTRRRLPLAPGLGAFATLSSLFPKKRGRGRRRAAWAGRQSRGRAPGETPGSVCVGRTLGARLRM

SEQ ID NO: 772736 - protein, 125 aa, Homo sapiens
GWRSVAWERRIDLETKTPGPDKNLEAWRQKNKIPHSLWRLWGRALPCPFLRLAAPNPWCFLTTRDLLRFRMPAPIRVSVLSVSYKDTLTGLEAPQIQDGLVPILTIMRSTKTCFRMRSPLKLQAI

SEQ ID NO: 772737 - protein, 120 aa, Homo sapiens
RVPRLNYQPPSHPKGCHHQKFNMLLVHAKKSPVIVGLISTLLIDPHFLLFYLKANTSFTIVTPELFIFSVQVCALFSKLFGSSVSEGLSHLFTIVDCAAFFVFNYRLYKILSAGGRLLLP

SEQ ID NO: 772738 - protein, 59 aa, Homo sapiens
EEDPVSKQIIINQDLKDKKTFAICRAGEKHGGTGSGMCKGPGAGKKSAFFPHSRLCKGP

SEQ ID NO: 772739 - protein, 49 aa, Homo sapiens
FSDIISYHFLPDSLCSTQSGLLDVAQARNAPTSASLRWLLPLPRLSVFP

SEQ ID NO: 772740 - protein, 472 aa, Homo sapiens
MSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 772741 - protein, 303 aa, Homo sapiens
MKERRCALRRLWKRRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 772742 - protein, 454 aa, Homo sapiens
MSENNKNSLESSLRQLKCHFTWNLMEGENSLDDFEDKVFYRTEFQNREFKATMCNLLAYLKHLKGQHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 772743 - protein, 472 aa, Homo sapiens; identical to SEQ ID NO: 772740

SEQ ID NO: 772744 - protein, 251 aa, Homo sapiens
MREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEEAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 772745 - protein, 158 aa, Homo sapiens
VDIHCIGSNSNILVGLDPWLALQGASSLATLFEASDLIQGFYRKGSCSCSSNVMQLAQKLQQQQQQQQQQQHLLGQVAIQQQQQGPGVQTNQVLGPKPQGLMPPSSHQGLLVQVSPQPTPGPGYAWLPQVGLLLQQQHPGALGPPRLTGQVFYDPVPG

SEQ ID NO: 772746 - protein, 63 aa, Homo sapiens
ERDPEAPAVFSEPSSHSAWPGGEAPYPPLGSPLAPGGGGVGRPAVWSAPMEIHCKHDPFASMH

SEQ ID NO: 772747 - protein, 109 aa, Homo sapiens
QGTTGSGDREGGRKMHPTNRKGKLIGQGVRPGGQSKRRAAPSLSNVAPAFQNRTLPGRQGRGGRRGAARRACPASDGGFQRVSRYARVPRYVSAQEAEAARLRVRGPSS

SEQ ID NO: 772748 - protein, 41 aa, Homo sapiens
MKSELEPGKGRDRNKGLEDRMDGEGCMETPGRRAEGLKAPG

SEQ ID NO: 772749 - protein, 68 aa, Homo sapiens
LTPLKRASRSERTKSFSVRDLGPSWERFLAEMAAVEPSDCQGEIVLQQAAVDSLPEWVRTGPEDRVVS

SEQ ID NO: 772750 - protein, 91 aa, Homo sapiens
RKSQHLKHNLCFSQTPDPRNNSSLVPWRWAGVERHGKCFSKEESFPAHSSYSMFLKVQINGFSLYLQENPNSCTDPMGLQGPVGSDCCLSL

SEQ ID NO: 772751 - protein, 73 aa, Homo sapiens
QGLKVRTKSLFPYPPHQGQFGVLSKGDALGPDSLAASPPSAANAASSHQLQTQAQRSCWEERRRIALSFAFLA

SEQ ID NO: 772752 - protein, 106 aa, Homo sapiens
IGTHHHTRLIFVFLVKMGFYHVGQAGLELLTSGDLPTLASQSAGITSVSHHTWRILTFSCTISSQYLCNRYYHYLYFIDEETERTWQLAQGHTAHWVITNPHKFGF

SEQ ID NO: 772753 - protein, 118 aa, Homo sapiens
LRLQGEVYRAEFCALAENECCCNGCMCPCSGRSWWCAIHVEPRIASWIFRPLDSASLRKVEIFSLLGGNTMESLFTGCGGWPTPGECPSLEVVGVLSNQLLPDEKKKAERACPPPHDT

SEQ ID NO: 772754 - protein, 155 aa, Homo sapiens
MERDKKDREGRETQRPERCIESGEVSCCRLRPAGGKVLSRAAKSPVVAFGQQEWQCLFGTWLHVSVLRKIMVVCIHVEPRIASWIFRPLDSASLRKVEIFSLLGGNTMESLFTGCGGWPTPGECPSLEVVGVLSNQLLPDEKKKAERACPPPHDT

SEQ ID NO: 772755 - protein, 486 aa, Homo sapiens
MLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGVLGLAPFPGPEAAASRSPLDAPFPAGSDALLPGPPDLYSPDLGAAPFPEAFWEASPCAGAPSQCLYEPQLSPPDVKPGLRRPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 772756 - protein, 150 aa, Homo sapiens
MLHLSEFSEPDALLVKSTEGCCAEPSAELPRLPARDAPAATGYPGGKEGEQGCSDDDGAARGRTIPENQEGLGHWSYENRGDGKLRSPGVRTPIPTHTGPPAPPQEPVRLSERPFACARVFCVCMFLCAPWDVCGPLLNQNVQKALCVYP

SEQ ID NO: 772757 - protein, 587 aa, Homo sapiens
MSQMLHIEIPNFGNTVLGCLNEQRLLGLYCDVSIVVKGQAFKAHRAVLAASSLYFRDLFSGNSKSAFELPGSVPPACFQQILSFCYTGRLTMTASEQLVVMYTAGFLQIQHIVERGTDLMFKVSSPHCDSQTAVIEDAGSEPQSPCNQLQPAAAAAAPYVVSPSVPIPLLTRVKHEAMELPPAGPGLAPKRPLETGPRDGVAVAAGAAVAAGTAPLKLPRVSYYGVPSLATLIPGIQQMPYPQGERTSPGASSLPTTDSPTSYHNEEDEEDDEAYDTMVEEQYGQMYIKASGSYAVQEKPEPVPLESRSCVLIRRDLVALPASLISQIGYRCHPKLYSEGDPGEKLELVAGSGVYITRGQLMNCHLCAGVKHKVLLRRLLATFFDRNTLANSCGTGIRSSTSDPSRKPLDSRVLNAVKLYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTPAAAARRPEGTYAGTL

SEQ ID NO: 772758 - protein, 293 aa, Homo sapiens
MVQEKPEPVPLESRSCVLIRRDLVALPASLISQIGYRCHPKLYSEGDPGEKLELVAGSGVYITRGQLMNCHLCAGVKHKVLLRRLLATFFDRNTLANSCGTGIRSSTSDPSRKPLDSRVLNAVKLYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTPAAAARRPEGTYAGTL

SEQ ID NO: 772759 - protein, 179 aa, Homo sapiens
MVLWPWGGAGLPAGRWLSSRRPVLTVYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTP

SEQ ID NO: 772760 - protein, 92 aa, Homo sapiens
PVTPSAAFNAKTLLTSTANPKPQPPSAVPWDPVAKRAPWITPPPEFQGPTLCVGVVCDLVAGKYPSCSWICFFFLLRQGLTLSLRLEYSSMT

SEQ ID NO: 772761 - protein, 68 aa, Homo sapiens
MFISSHFWHFLLSSSWTVLQGCSDNATIEEVLEVLFFRIPLMGWCEAAIAQHLGCGLKVREEKGRALA

SEQ ID NO: 772762 - protein, 156 aa, Homo sapiens
MGLYIGWRCPHYLWDCFRIGDESRCFCGHLLREHRIISDISVPCKVSQCRCFMFCFIPSRPEEVGEFWLKRRATFDPKAWRAQCRCKHSHEEHAATGPHPCRHHGCCCGCFESNFLCAACDRRWEEHETFFDTQKTRQRGGRPRGTDTVSNWHRPL

SEQ ID NO: 772763 - protein, 381 aa, Homo sapiens
RDFLLGHVDAESLVRHHPDCKDLLIEALKFHLLPEQRGVLGTSRTRPRRCEGAGPVLFAVGASPGAWGVAQRVGSTHESRLHLPSPGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEKYEPQVNVWSPVASMLSRRSSAGVAVLEGALYVAGGNDGTSCLNSVERYSPKAGAWESVAPMNIRRSTHDLVAMDGWLYAVGGNDGSSSLNSIEKYNPRTNKWVAASCMFTRRSSVGVAVLELLNFPPPSSPTLSVSSTSL

SEQ ID NO: 772764 - protein, 174 aa, Homo sapiens [sequence omitted]

SEQ ID NO: 772765 - protein, 256 aa, Homo sapiens
MCVCFCRGGGMGPCRAAQGRVGWDFSREGARPGPGPGSSRHPHPSLLQGTAKAKPSSGWDYVYWVDPWRGAARRDLGGREKQRQRGHEEGSASEKGQAVTITPFLLPSAGVTRVRQSLKTWVEHGPFSGDPGLPRSVRVELLTLVAGPARGRSGHRQPPPQPQSLRRPLWLSHSDPSLKFRTLGLREGSGAECLPPGTFLPFSWSFSAPELAHLSNARAPWIPLPGAFQIQQKQIFFFLESRTKSGMRSRGGKDSK

SEQ ID NO: 772766 - protein, 256 aa, Homo sapiens; identical to SEQ ID NO: 772765

SEQ ID NO: 772767 - protein, 256 aa, Homo sapiens; identical to SEQ ID NO: 772765

SEQ ID NO: 772768 - protein, 103 aa, Homo sapiens
MQVASPLVCSLASISPEGQEWCGAGEGQSHTWIPHPLQIQAPEVRNQITESEMEIPRKIFKANLQGISPHHPHRVQPYQRCPCYGKSDRNLPSSPSPVRSSPV

SEQ ID NO: 772769 - protein, 167 aa, Homo sapiens
ERAEALDRQRTKNISAISYINQRNREWNIVESEKALVVKVTNMKNQQMDPFTRRQCKPTIVSNSRDPAVQAAILAQLNAKYGSGVLPDAPKEMSKGQGKDKDLNSKSASGPLQKICFKVTRFWMWKIGLYKFPQLQSSKGFSHSTFQGFGSPRMGVPRRFLEFGRFP

SEQ ID NO: 772770 - protein, 111 aa, Homo sapiens
HAFAVPLASTAAPCTLPFALCDSPQAPPPCPTFPGTVPCLPCSWLSSLVTCGYDKKVEDVGVGERRVEGGKQKKKVKEALEETTGPVGKEGHCRGNPWLWGKGIGPGYPIA

SEQ ID NO: 772771 - protein, 110 aa, Homo sapiens
QVEVNLLLLSAVLLRTSRILCIFWLQREAHLLIFTAGYLESWKTKTSQLQETTLDKHKHDFPQEGLSQCRADLLDFKHADGKCSPPRSRAMVVYYLILLVDKNGQLRTVF

SEQ ID NO: 772772 - protein, 124 aa, Homo sapiens
FLFQLLQSCPALFTSSPSVYLLKRTAWFQEAGRGISEVWRKQTSQGTEVGVGQGRRADPLTRSKHRVAVPVYKPKTRKPKPGNKTTKQNKIRKSTALGKNKQTQAPNPVPTPLSASLFQHPCFV

SEQ ID NO: 772773 - protein, 1021 aa, Homo sapiens
MAGISYVASFFLLLTKLSIGQREVTVQKGPLFRAEGYPVSIGCNVTGHQGPSEQHFQWSVYLPTNPTQEVQIISTKDAAFSYAVYTQRVRGGDVYVERVQGNSVLLHISKLQMKDAGEYECHTPNTDENYYGSYRAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVVSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQGQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 772774 - protein, 1021 aa, Homo sapiens; identical to SEQ ID NO: 772773

SEQ ID NO: 772775 - protein, 101 aa, Homo sapiens
WTQKFRVQSLGELTLPLQQLQTYDKCFGLTWFLGNLRRQVFTSFPEQQKSHNGRAWFSRISSHILSTLPPWSLGWGAALGMYPPMLLALGSRSEVGFYFVL

SEQ ID NO: 772776 - protein, 89 aa, Homo sapiens
VFETEVPSTLRRVEKDGSLKHGVFLPAGRLRGHSWLQKGLGFAGVDGERPRSGQEARAGPGLSRTGRAGVTVPSQTVLLISPLVCNSTR

SEQ ID NO: 772777 - protein, 116 aa, Homo sapiens
GPSWPPSPRTEFVFKEKLTMKTASLTEEKLECSLWCCLSDPSPRGLAARCCVLEGLIVQSRRQESSSSFSPICFVDSDEPNLTSVLEHLEDTKNNHSVKREAKLFSLFLMNIIFRN

SEQ ID NO: 772778 - protein, 114 aa, Homo sapiens [sequence omitted]

SEQ ID NO: 772779 - protein, 111 aa, Homo sapiens
LQEEKTRVSQHHLDQQLNSEAQRSNSLVAQLQAMVAEREAKVRQLEMEIGQLNVHVSRALAAPKPIFKPGKSIQLLPLLSTCLSSGQTSSFLAPLWPPASIWLPNPFCTQT

SEQ ID NO: 772780 - protein, 673 aa, Homo sapiens
MCWLSHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSSSPNRDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 772781 - protein, 667 aa, Homo sapiens
MCWLSHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSSSPNRDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKSGGA

SEQ ID NO: 772782 - protein, 772 aa, Homo sapiens
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSSSPNRDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 772783 - protein, 168 aa, Homo sapiens
NSVMQVAAKGPSLREAKGQMSPFPLPFHHLPPPSKPGTHRLGPEPRGCPHPATEGGTMQMSSRSKPFNSWLRRGLGGGCGPALGTTRVDQAWRALPPQSPTHLLRLSLAHPLPRVNVASTSWIATAQLGGTWRDAPRQPPVDLAWMAPPCNQAAETRVLSLWDLGGRG

SEQ ID NO: 772784 - protein, 769 aa, Homo sapiens
KEQERIKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 772785 - protein, 53 aa, Homo sapiens
GKAAPHRVFLSFLFLLHLVNPYTYSMVQFKCYHVYNALSYPQSRGNLSFPHLT

SEQ ID NO: 772786 - protein, 100 aa, Homo sapiens
HTHTLTALTPQPSLLTGPPLNRGFLCYGMRFLLAEEKWLSGRWAGAPLTSLSVAATTSAASPPLLLPRTPQPQPESRCLYFLLPQRAQLPTKTPAGGLSS

SEQ ID NO: 772787 - protein, 108 aa, Homo sapiens
LTWHPGGHALGKAASTRPCFSSSSLVNKSKTSSQKTKQNKNNNKKQKKNKQNQNQNSCIEAAVLQLCDCPAEQGYPIGSEQQLRAVLQSDLYPLLITCRLRSCIYKDF

SEQ ID NO: 772788 - protein, 384 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 772789 - protein, 270 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGARGCRGGQ

SEQ ID NO: 772790 - protein, 321 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 772791 - protein, 108 aa, Homo sapiens; identical to SEQ ID NO: 772787

SEQ ID NO: 772792 - protein, 384 aa, Homo sapiens; identical to SEQ ID NO: 772788

SEQ ID NO: 772793 - protein, 384 aa, Homo sapiens; identical to SEQ ID NO: 772788

SEQ ID NO: 772794 - protein, 376 aa, Homo sapiens
MDAALLLNVEGVKKTILHGGTGELPNFITGSRKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 772795 - protein, 148 aa, Homo sapiens
GSDRAVTGCYFSHGLGFTSDYWAATSIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 772796 - protein, 207 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGARGCRGGQ

SEQ ID NO: 772797 - protein, 140 aa, Homo sapiens
GTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVSQSTKPWELVRSIWTPES

SEQ ID NO: 772798 - protein, 225 aa, Homo sapiens
GTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEERSLFQFLNRRREETQLLDA

SEQ ID NO: 772799 - protein, 95 aa, Homo sapiens
LGTVSYGADTMDEIQSHVRDSYSQVKWVPPARGLLPHTSRAMSPAEPRVFTICKLARFLVVLTSCYFSRLFEYTNQEIVFDEHLYMSEIVEGIVC

SEQ ID NO: 772800 - protein, 246 aa, Homo sapiens
GTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEEETGRDTAVGCIKKGARPTPLLQPFLPSLQPPVQRQIQSTG

SEQ ID NO: 772801 - protein, 155 aa, Homo sapiens
TLVLHLQETLVALALLLGQFAEEVAHAFQSHIIAVEIEAQREVGVGGLQVQIDQAVDGCLHVGGIILTNLGAHGWLARRSLPQNRAGRSQKQEMAEKMVPEVASGEEIGGRSEAGRESPDLFRPNTVEARDRHSSGHLNLLRKHGQRLERSAYRM

SEQ ID NO: 772802 - protein, 77 aa, Homo sapiens
SSCVILPSLVNTKKYTFSDPAMKQFLLYLDESNALGKKFIIQDIDDTHVFVIAELVNVLQERVGELMDQNAFSLTQK

SEQ ID NO: 772803 - protein, 117 aa, Homo sapiens
CSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 772804 - protein, 185 aa, Homo sapiens
TSSAPPCAQPAMGKITLYEDRGFQGRHYECSSDHPNLQPYLSRCNSARVDSGCWMLYEQPNYSGLQYFLRRGDYADHQQWMGLSDSVRSCRLIPHSGSHRIRLYEREDYRGQMIEFTEDCSCLQDRFRFNEIHSLNVLEGSWVLYELSNYRGRQYLLMPGDYRRYQDWGATNARVGSLRRVIDFS

SEQ ID NO: 772805 - protein, 294 aa, Homo sapiens
MPRFLRQTLGIQRRKINTAAPLIASSEETKQRCAGGSGQNQPSLLPLLRRGPPLLALLSFAWLSSAQLSAAPRPPSRGGHGLRVADASSELPLSAAPPPGRAFVGTTSGRSRVAKACGRGTKLGAAKMRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQEIWGSMWQISPVTLQRRCFKTGSLSSHRFGVYAHYPNYAAATAPKSIFSNFN

SEQ ID NO: 772806 - protein, 317 aa, Homo sapiens
MPRFLRQTLGIQRRKINTAAPLIASSEETKQRCAGGSGQNQPSLLPLLRRGPPLLALLSFAWLSSAQLSAAPRPPSRGGHGLRVADASSELPLSAAPPPGRAFVGTTSGRSRVAKACGRGTKLGAAKMRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQGKTLWV

SEQ ID NO: 772807 - protein, 133 aa, Homo sapiens
LGAAKMRLSPAPLKLSRTPALLALALPLAAALAFSDETLDKVPKSEGYCSRILRAQGTRREGYTEFSLRVEGDPDFYKPGTSYRGKWPPGVALGERDPVPGGRRPRGAGGGRAVSGRVARVQPGKGPSVLAAL

SEQ ID NO: 772808 - protein, 68 aa, Homo sapiens
IAPTSVTQATLLLRLNPGSFQLLVPVLREPGHSCATGITLAVPLFRRQHLNSPCAFSWIIALIPTIAQ

SEQ ID NO: 772809 - protein, 102 aa, Homo sapiens
EGQAPTRRPRVPTCVTQPGNHVQSDPKRSLTLSGHELRAIQIQFHSEQHMDPLFLPLGAHREMDTCTLPFTLCSHEARKHLKGALSSEQKPHTLWFFHFSPQ

SEQ ID NO: 772810 - protein, 100 aa, Homo sapiens
MNLALPLQQASAWKQWEVEVGVAGADPSPVVKHHLLDADLVILSSHEIWLYNRVGTSFLSQSCFYCCHMKHFLAPWPSGMIGRLPESSRKQKPLCFLYSL

SEQ ID NO: 772811 - protein, 146 aa, Homo sapiens
KTKNGSFEKINKTDKPSARLTKKRRQKIQITSLRNERGDTTTDTTEIQKIIQGCYEHLYVNKLENLEEMNIFMEKYSSPRLNQDKLDTLSRPTTSSEIEIVIEKLPTKIKYRTRQIHSRILPDILRRIGTNPFDTNSQDRERRNPP

SEQ ID NO: 772812 - protein, 190 aa, Homo sapiens
EEKISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRAACNLAAGLPYSE

SEQ ID NO: 772813 - protein, 148 aa, Homo sapiens
KRKSVTFQFLKELQNELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRAACNLAAGLPYSE

SEQ ID NO: 772814 - protein, 192 aa, Homo sapiens
KRKSVTFQFPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINSCTDPWYSVGGDNTGY

SEQ ID NO: 772815 - protein, 328 aa, Homo sapiens
GGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGSTS

SEQ ID NO: 772816 - protein, 110 aa, Homo sapiens
LCWIRNEAPKEAQPGKWPHSLDQHLWERKKGSHGDSPHRSFLEPVTLKNKCVATDEHAHPLQLPVYKLSEALECLWSMGSREVGNSIMIQMSSNFKVSFPFFLCWKCSQI

SEQ ID NO: 772817 - protein, 721 aa, Homo sapiens
MVCFSNFFHINKVETHLVETMLFIPGLFGCCCFKNYYPPASWIFSVFSNLLVRCLTSENNFLTFKVLLFDFLRDFLTLFFNFSNQNYFRAMMVFISNILFYIYWLLQFLFYGHYIFSYFCEDTNYGFKQFFFVSIALDLLFLRFFKEVCVSVYRGGSVCISPPPPRFFIIEVFFKCLMILDYLFKCKSSAPGISLASFVCVYVGGVQLVSFIVLYNDLGENQLFSWELPKVSIQAAFSVVVQFLSVRNFQSHTCEYTPVASILRAGVCVCVCVCVCAGKEVDLVILKLEEQEEGGGGANIEYLFCTRHHPKCYSSLSPHISSAALHLLLSSFFFEMRKVRYRDVKQLAQSKASLLIDRAEIELRNLLDSMYLAFHNIILVFNPCHYLLLCLRFPKRVVANPENNPSVPDVGGEKNCLVTSHMAQQGRGVPSWLLNVGMECEAGGQVRGYYRWEVSPLCGEEGLLPLVLLQVWDSRTLDTNVPNLEGILDCILCSSFIFPPRKPAEPDLGPQLCMELPIGPSTARVLVRNTEMNPCALGSGYRILLGGFCLEVGHFSGIWYRMGGKGATRKNMRICTVQQFGVSSWVTHNLDSKLPKQTHLCILPKILLLGVFIVPSGNLHLVSLPHCCCFREFLLTCVVFSIGLVRFGLLKYRGDCLYLRDFFFILLVKLTSSLSFSSLYIIPVTTFKAKPRFVCFSSVLSLLIKFLEFKEEFINQNLNIK

SEQ ID NO: 772818 - protein, 82 aa, Homo sapiens
HRCHSEVQSNIHISLLPGLLAVFRQRFLRHGLHKFRVLPGDRGIDKHRGLSIHLGNLSISIYFNNHIQSSGTFFHKCFQSSL

SEQ ID NO: 772819 - protein, 193 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMQLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 772820 - protein, 242 aa, Homo sapiens
ASQSTGLGVRETWLRIPAPPLSSAVTLAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMQLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 772821 - protein, 193 aa, Homo sapiens; identical to SEQ ID NO: 772819

SEQ ID NO: 772822 - protein, 219 aa, Homo sapiens [sequence omitted]

SEQ ID NO: 772823 - protein, 219 aa, Homo sapiens [sequence omitted]

SEQ ID NO: 772824 - protein, 219 aa, Homo sapiens [sequence omitted]

SEQ ID NO: 772825 - protein, 193 aa, Homo sapiens; identical to SEQ ID NO: 772819

SEQ ID NO: 772826 - protein, 193 aa, Homo sapiens; identical to SEQ ID NO: 772819

SEQ ID NO: 772827 - protein, 132 aa, Homo sapiens
MEPSAQQLQLAASLPANLSNFCQGSEMPTTSRPALDVKGGTSPAKEDANQEMSSVAYSNLAVKDRKAVAILHYPGVASNGTKSPAIIDSDPVDEEVLMSLVVELGLDRANELPELWLGQNEFDFTADFPSSC

SEQ ID NO: 772828 - protein, 110 aa, Homo sapiens
MSASKPSRSAVWIFKFLLLSEKIAIEMEPSAQQLQLAASLPANLSNFCQGSEMPTTSRPALDVKGGTSPAKEDANQEMSSVAYSNLAVKDRKAVAILHYQPCYHRFGPSG

SEQ ID NO: 772829 - protein, 193 aa, Homo sapiens; identical to SEQ ID NO: 772819

SEQ ID NO: 772830 - protein, 219 aa, Homo sapiens [sequence omitted]

SEQ ID NO: 772831 - protein, 161 aa, Homo sapiens
MPTTSRPALDVKGGTSPAKEDANQEMSSVAYSNLAVKDRKAVAILHYPPSFNLHPAPHLLASMQLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 772832 - protein, 30 aa, Homo sapiens
MLPGHIATSGLLLAQHSEMDAIAADSRKPR

SEQ ID NO: 772833 - protein, 209 aa, Homo sapiens
KIMHRDVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 772834 - protein, 209 aa, Homo sapiens; identical to SEQ ID NO: 772833

SEQ ID NO: 772835 - protein, 209 aa, Homo sapiens; identical to SEQ ID NO: 772833

SEQ ID NO: 772836 - protein, 209 aa, Homo sapiens; identical to SEQ ID NO: 772833

SEQ ID NO: 772837 - protein, 164 aa, Homo sapiens [sequence omitted]

SEQ ID NO: 772838 - protein, 214 aa, Homo sapiens
KIMHRDVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTLSLFRCAFHL

SEQ ID NO: 772839 - protein, 111 aa, Homo sapiens
FSSPRRNRSEGSRGDLFREMKLLEHLKSLHVLRRDLDERIESFISNTYIENKENEISSLVSLQRKHKAVSQRKSTYNLTVREGHMWTLCYFCHFFMCLKPFQKKKQSQCMW

SEQ ID NO: 772840 - protein, 460 aa, Homo sapiens
MDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 772841 - protein, 539 aa, Homo sapiens
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 772842 - protein, 113 aa, Homo sapiens
TNVASVFPTRITAHSSDFSWTELKRLNAGSWFLEVRTASAKRQPSAGTLREGRVHSVDKHLLSPVLGNKNIVCALKSLPPSREPRQQTIQETQSNKNIFLPGRESGVDSYRRG

SEQ ID NO: 772843 - protein, 509 aa, Homo sapiens
MGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 772844 - protein, 502 aa, Homo sapiens
MGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 772845 - protein, 461 aa, Homo sapiens
MPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 772846 - protein, 256 aa, Homo sapiens
MGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEALPRVSSGLLCSSPFPSWTRPSLTPPRTTL

SEQ ID NO: 772847 - protein, 509 aa, Homo sapiens; identical to SEQ ID NO: 772843

SEQ ID NO: 772848 - protein, 169 aa, Homo sapiens
MPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKTRQGASGGAGPAGHAGARLQPVSPALQVFLLWEAS

SEQ ID NO: 772849 - protein, 253 aa, Homo sapiens
RSCRIRQEALLGGAWSPGAPHRSRDLLGAGPNRRRREPLGHPRRSSPRPTFPQVAEPAGRAKLAGPPGGSRWPRPSREGPAPRGAPEPSRPPPPGGMEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPREEPVSNLYKTSTF

SEQ ID NO: 772850 - protein, 285 aa, Homo sapiens
RSCRIRQEALLGGAWSPGAPHRSRDLLGAGPNRRRREPLGHPRRSSPRPTFPQVAEPAGRAKLAGPPGGSRWPRPSREGPAPRGAPEPSRPPPPGGMEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPRFGYTISKPAFVFVRHLITLCALSWAKKEGRETLWTIEEGGAKMAE

SEQ ID NO: 772851 - protein, 91 aa, Homo sapiens
LARVRYIGIHVPWWFAEPINPLIFKDKAFSISSSVVQRNILKKLRNTRFLMKCLIRKMMEDTEEQQNWVEDYYRCQIATSERKAYDNWLCV

SEQ ID NO: 772852 - protein, 85 aa, Homo sapiens
EEMQPNAYNCSCGTHTDSQPPLSPGSALGGRGPLDRANPQDGPADPSRPQSGAKVYNLRAQGTCIRPKKEIVVFQQSSRGRPDSK

SEQ ID NO: 772853 - protein, 164 aa, Homo sapiens
MKDRLQELKQRTKEIELSRDSHVSTTETEEQGVFLQQAVIYEREPVAERHLHEIQKLQESINNLADNVQKFGQQQKSLVASMRRFSLLKRESTITKEIKIQAEYINRSLNDLVKEVKKSEVENGPSSVVTRILKSQHAAMFRHFQQIMFIYNDTIAAKQEKCKT

SEQ ID NO: 772854 - protein, 176 aa, Homo sapiens
DGVWLYRQAGMQWRDLSSLQPPPPGFKRFSCLSTSSSWDYRRAPPRPDEKTEAQRGEIRPPECSSPRLRKIKCYPSLKIHPSSPSLKSPAARSRSSIYPHLDSLALCCTCLSPHLFTHTHTHTHTHTEYYNTITYYITLYYCSSTGTTRNSTVNSLRVGYILQSSLFLSLVVESKK

SEQ ID NO: 772855 - protein, 279 aa, Homo sapiens
QFVQPEERRQGSLLGPGLPSHALGTLAKVAGRQDAAPPGGSAASEEREEGPSVEALAVSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPL

SEQ ID NO: 772856 - protein, 302 aa, Homo sapiens
SLCNQRSAGRVPCWGPGCPAMLWALWPRWLADKMLPLLGAVLLQKREKRGPLWRHWRRETYPYYDLQVKVLRATNIRGTDLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPL

SEQ ID NO: 772857 - protein, 81 aa, Homo sapiens
QFVQPEERRQGSLLGPGLPSHALGTLAKVAGRQDAAPPGGSAASEEREEGPSVEALAGNVPEITWETRTGGVLGAAVPCED

SEQ ID NO: 772858 - protein, 103 aa, Homo sapiens
KKIFNLNLKKRPPVIHNPSSWAPAPNTHTHTHTHTLCCSVLLFSQTSHAPLSPGLLVLFPLLGTCSLPPPSPYLGKSYSFFRLNFIHFFHGKTSMSHSYPASG

SEQ ID NO: 772859 - protein, 289 aa, Homo sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 772860 - protein, 296 aa, Homo sapiens
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 772861 - protein, 672 aa, Homo sapiens
GTQRNRGPRQASRDGRRCPGLRRLQSELPSEAGVGKMAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 772862 - protein, 478 aa, Homo sapiens
GTQRNRGPRQASRDGRRCPGLRRLQSELPSEAGVGKMAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPTLSPATAPACSMAGVGGDRSVGSDFQASS

SEQ ID NO: 772863 - protein, 508 aa, Homo sapiens
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 772864 - protein, 508 aa, Homo sapiens; identical to SEQ ID NO: 772863

SEQ ID NO: 772865 - protein, 498 aa, Homo sapiens
RAQVSKILGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 772866 - protein, 396 aa, Homo sapiens
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSCSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 772867 - protein, 508 aa, Homo sapiens; identical to SEQ ID NO: 772863

SEQ ID NO: 772868 - protein, 508 aa, Homo sapiens; identical to SEQ ID NO: 772863

SEQ ID NO: 772869 - protein, 325 aa, Homo sapiens
MKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 772870 - protein, 174 aa, Homo sapiens
MGKITFYEDRAFQGRSYETTTDCPNLQPYFSRCNSIRVESGCWMLYERPNYQGQQYLLRRGEYPDYQQWMGLSDSIRSCCLIPQTVSHRLRLYEREDHKGLMMELSEDCPSIQDRFHLSEIRSLHVLEGCWVLYELPNYRGRQYLLRPQEYRRCQDWGAMDAKAGSLRRVVDLY

SEQ ID NO: 772871 - protein, 176 aa, Homo sapiens
MPPFTITFYEDRAFQGRSYETTTDCPNLQPYFSRCNSIRVESGCWMLYERPNYQGQQYLLRRGEYPDYQQWMGLSDSIRSCCLIPQTVSHRLRLYEREDHKGLMMELSEDCPSIQDRFHLSEIRSLHVLEGCWVLYELPNYRGRQYLLRPQEYRRCQDWGAMDAKAGSLRRVVDLY

SEQ ID NO: 772872 - protein, 107 aa, Homo sapiens
SRGPDYRTSKCSPLARLCHLAWVLFASSLTIQKISPYQIALLRQCLQEREREFTAPHSGQPHYSQSHTSRQLQVSLTRLIGEGTNFNHCQMLTSKCFGTKSIIFVQH

SEQ ID NO: 772873 - protein, 134 aa, Homo sapiens
GVAYISAVLSISFAHPLAFLTLLPTSISQFFSGAVLGSEMFVILMLYLWFAIGLACAGFCCHQLLLILRGQTLPPGAEGGGSEGPDPGARTYKRSSERGGCWACWSPCSMSEVRAPSSRISSRHSRQFISLSLS

SEQ ID NO: 772874 - protein, 134 aa, Homo sapiens; identical to SEQ ID NO: 772873

SEQ ID NO: 772875 - protein, 134 aa, Homo sapiens; identical to SEQ ID NO: 772873

SEQ ID NO: 772876 - protein, 134 aa, Homo sapiens; identical to SEQ ID NO: 772873

SEQ ID NO: 772877 - protein, 110 aa, Homo sapiens
GKEKRRRDYLPAFSFYQFPSSNSEQTGSAVSGSSLTSRVGLIPFCGPRIMGSPCNLLQDSSPSFPVSGSMNTTFSLFFSQPQSCYVLISGLLYCLCFAFSALPYAATFLS

SEQ ID NO: 772878 - protein, 98 aa, Homo sapiens
AMFVVWPWPPLVISDWTVDGHLTRAGQSEPAGIGPRHVAEVRTCNTGTHRWDAVDLGHRAGVEGKEREEMGREGHGIGVHISVLVLHESWWHLLAWFP

SEQ ID NO: 772879 - protein, 169 aa, Homo sapiens
GRRWGPPREKKSGKRRTARPRFQLRDGQGRPPGAGKDVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 772880 - protein, 163 aa, Homo sapiens
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 772881 - protein, 163 aa, Homo sapiens; identical to SEQ ID NO: 772880

SEQ ID NO: 772882 - protein, 163 aa, Homo sapiens; identical to SEQ ID NO: 772880

SEQ ID NO: 772883 - protein, 104 aa, Homo sapiens
MRRLLIPLALWLGAVGVGVAELTEAQRRGLQVALEEFHKHPPVQWAFQETSVESAVDTVSSMARAGAGRVVPQETSAFPRRGQKCLGSEPQPFGEKATVQPAGM

SEQ ID NO: 772884 - protein, 163 aa, Homo sapiens; identical to SEQ ID NO: 772880

SEQ ID NO: 772885 - protein, 163 aa, Homo sapiens; identical to SEQ ID NO: 772880

SEQ ID NO: 772886 - protein, 163 aa, Homo sapiens; identical to SEQ ID NO: 772880

SEQ ID NO: 772887 - protein, 85 aa, Homo sapiens
SAHPMLPAPPQRKRKCLACIKLGSEDKVLGRLVHCPIETQVLREAEEHQETQCTWATRWPNAAAGVVLVVRIQLCLGHVQPHLPY

SEQ ID NO: 772888 - protein, 163 aa, Homo sapiens; identical to SEQ ID NO: 772880

SEQ ID NO: 772889 - protein, 124 aa, Homo sapiens
MRRLLIPLALWLGAVGVGVAELTEAQRRGLQVALEEFHKHPPVQWAFQETSVESAVDTVSSMARAGAGRVVPQETSAFPRRGQKCLGSEPQPFGETRACSAPSAGYRPSSACLSVRSPSQLEYL

SEQ ID NO: 772890 - protein, 148 aa, Homo sapiens
TLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHW

SEQ ID NO: 772891 - protein, 51 aa, Homo sapiens
MTHVYWAPVMDQPCARTWGAAVNKVHIAAALRVGLVVKRALGWWLESQLLD

SEQ ID NO: 772892 - protein, 128 aa, Homo sapiens
ERTNPLTGLGPIPLSPTLLLLSYLILLPIVSLDFSGLTWASGTHVAHSVVPIMSALERLLGQPVWNSQSPRVLELLQSATRSFCLITNTIPFILATRPRKRWLSMSKAPGNEDWKCETTGHRGMGGSE

SEQ ID NO: 772893 - protein, 182 aa, Homo sapiens
MCTPVRVSIVCVMGAVGAVWTAPLPLPWAPTPSIHLREEGAAFPFCRVCVLRPRRSKWRSWDVNLGPRRRGLLGCGPCPSGKPRVHLQRTRSGAGAEAGGLPTRGSMRGCPFLGSSAAKCSLLLRPPSRGEASPWLPEFMTHPVHHQQLACVSGWLGTSLLEATCLGPHGGSWWGHHPGSRE

SEQ ID NO: 772894 - protein, 182 aa, Homo sapiens; identical to SEQ ID NO: 772893

SEQ ID NO: 772895 - protein, 188 aa, Homo sapiens
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGRDICSSGVFLK

SEQ ID NO: 772896 - protein, 255 aa, Homo sapiens [sequence omitted]

SEQ ID NO: 772897 - protein, 75 aa, Homo sapiens
NLAPNNEHTEILMKQYRRSDNTQQILTWGVFHTHTCTYTHTSRHLPHENNHQFLMKTLSGSQFPIVNNLGENYNA

SEQ ID NO: 772898 - protein, 71 aa, Homo sapiens
PSACWSSAPSGSQAYHVTSSPNSSAHKVPKPSSKLAGSGQHGILFLCLYGLGNDIKSLLHQNTCAVKDTAE

SEQ ID NO: 772899 - protein, 773 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPE

SEQ ID NO: 772900 - protein, 861 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYL

SEQ ID NO: 772901 - protein, 826 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPEMT

SEQ ID NO: 772902 - protein, 193 aa, Homo sapiens
MCKYHPLCALEAVFQIACTGGSIGPVPTESAGNSAPSTPRPCRSDYPCRGPLDGTKIGPGKQVTLTSEPLPEGLAWQLCFRSRRCAGGGEQPSLCDLLHGRISQQVEQSRSQVQAIGEKVSLAQAKIEKIKGSKKAIKVFSSAKYPAPERLQEYGSIFTDAQDPGLQRRPRHRIQSKQRPLDERALQVCWLRT

SEQ ID NO: 772903 - protein, 137 aa, Homo sapiens
MTYGLREAGRGQKGAPLWGGAAKGKKTPPPFFFSGRTNLGGGGAPTKGARAVADMPQDCAGTPQGALEPCVQEATALLTCGPAHPWKSVALEEEQEGPGTRLPGNLSSEDVLPAGCTEWRVQTLAYLPQEDWAPTSL

SEQ ID NO: 772904 - protein, 104 aa, Homo sapiens
MFFQPLYSVHNGNFQQVEQSRSQVQAIGEKVSLAQAKIEKIKGSKKAIKVFSSAKYPAPERLQEYGSIFTDAQDPGLQRRPRHRIQSKQRPLDERALQVCWLRT

SEQ ID NO: 772905 - protein, 103 aa, Homo sapiens
NTLVAVSIFLLLTGPTYLLFKLSPRVKRIFYQNVPSPAMFFQPLYSVHNGNFQLSAPTMCLTSSFCEGVCPVAMGKGLWCVCCPWGSHCLWAPALPGPLVSPD

SEQ ID NO: 772906 - protein, 43 aa, Homo sapiens
MCKSYELLSPTLDHHSRACPWVLRCILADFCSYLDFLAQSFGG

SEQ ID NO: 772907 - protein, 128 aa, Homo sapiens
WSARGQCPLPGGRLQTQTRGLRRWEAPVRAGWRPERTCQLLVGLKSATRQRVGGEPRVLHTKHSDDRGGEGSAHLLGVVRVSLSRRQLADKGVEPRGCFLHQATGLVALAHGWRGSQVSRGSRQEAEC

SEQ ID NO: 772908 - protein, 76 aa, Homo sapiens
EDLWAEEYAQQDCVKKSYSKAFTLDISALFVTPKTTGARVELSEQQLQLWPSDANQDGWDGCSHLAFLSCGQTSPI

SEQ ID NO: 772909 - protein, 69 aa, Homo sapiens
MCRDLLQPRRAARRPYAPINANAIKAECSIRLPKAAKTPLKIHPLVRLPLATIVKDLVAQTPPLPPLEP

SEQ ID NO: 772910 - protein, 668 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772911 - protein, 668 aa, Homo sapiens; identical to SEQ ID NO: 772910

SEQ ID NO: 772912 - protein, 730 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEVRKRCGEKSEGNGYCPQKRGGKEHNDEVQGCQTAGHGNSDTPPSLPPMWIAALLTLSLPNFQDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772913 - protein, 744 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFVSGWHYGGEVGEMTGEENQDLGPDASSFFLPLPPLATLEVTCQHSPVLLHVENHRPVYSAGIIWAGEGGPYGYLLTSAFEVDDILPGYEALILLFLFTFLQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772914 - protein, 676 aa, Homo sapiens
LAARNGGGLFLPLGGVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772915 - protein, 613 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDI

SEQ ID NO: 772916 - protein, 201 aa, Homo sapiens
MCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772917 - protein, 525 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLARRVSFVV

SEQ ID NO: 772918 - protein, 138 aa, Homo sapiens
YNRARTPGSELEDRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 772919 - protein, 668 aa, Homo sapiens; identical to SEQ ID NO: 772910

SEQ ID NO: 772920 - protein, 144 aa, Homo sapiens
RDGARRSEAGGAGGQREVRGCSAQETMSGGSSCSQTPSRAIPATRRVVLGDGVQLPPGDYSTTPGGTLFSTTPGGTRIIYDRKFLMECRNSPVTKTPPRDLPTIPGVTSPSSDEPPMEASQSHLRNSPEDKRAGGEESQFEMDI

SEQ ID NO: 772921 - protein, 144 aa, Homo sapiens; identical to SEQ ID NO: 772920

SEQ ID NO: 772922 - protein, 72 aa, Homo sapiens
GTGRGGARLEAREGSERFAGAAHRRPPLREHQQIPPCASTDAGAATPRGVTPASTPCSQGPGSGQERTLPSE

SEQ ID NO: 772923 - protein, 138 aa, Homo sapiens
LVTGFWARLVRFAEGLAHETMSGGSSCSQTPSRAIPATRRVVLGDGVQLPPGDYSTTPGGTLFSTTPGGTRIIYDRKFLMECRNSPVTKTPPRDLPTIPGVTSPSSDEPPMEASQSHLRNSPEDKRAGGEESQFEMDI

SEQ ID NO: 772924 - protein, 144 aa, Homo sapiens; identical to SEQ ID NO: 772920

SEQ ID NO: 772925 - protein, 144 aa, Homo sapiens; identical to SEQ ID NO: 772920

SEQ ID NO: 772926 - protein, 144 aa, Homo sapiens; identical to SEQ ID NO: 772920

SEQ ID NO: 772927 - protein, 144 aa, Homo sapiens; identical to SEQ ID NO: 772920

SEQ ID NO: 772928 - protein, 132 aa, Homo sapiens
MSPPWKPARATCAIAQKISGRAVKSHSLRWTFKAPAIVWSTTKGPLRAFLGGVPPARPYESDHTGQALAWGRTPQPFLPHSGHLPPPLREHQQIPPCASTDAGAATPRGVTPASTPCSQGPGSGQERTLPSE

SEQ ID NO: 772929 - protein, 144 aa, Homo sapiens; identical to SEQ ID NO: 772920

SEQ ID NO: 772930 - protein, 177 aa, Homo sapiens [sequence omitted]

SEQ ID NO: 772931 - protein, 300 aa, Homo sapiens
MAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKLKYDEKIKNIREEAERNIFKDVFNRIWKMLSEIWHRFLSKCKFYSS

SEQ ID NO: 772932 - protein, 400 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAK

SEQ ID NO: 772933 - protein, 109 aa, Homo sapiens
MSEREVSTAPAGTDMPAAKKQKLSSDENSNPDLSGDENDDAVSIESGTNTERPDTPTNTPNAPGRKSWGKGEDHNQPLFGVQFNWHSKEGDPLVFATVGSNRVSVKGSI

SEQ ID NO: 772934 - protein, 441 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 772935 - protein, 441 aa, Homo sapiens; identical to SEQ ID NO: 772934

SEQ ID NO: 772936 - protein, 415 aa, Homo sapiens
MIRMICALWRENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 772937 - protein, 147 aa, Homo sapiens
IFQSGRAILHSHQQCMRDPVSPNLRQHLSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 772938 - protein, 95 aa, Homo sapiens
LEPPIDIDRTRAIVLIPANSAIMAGVTEIMPNFSCENAIVCWKPGKMEDDIDKIKPSESNVTILGRFDYSQCDIWYMRFSMDFWQKVSTYFYILK

SEQ ID NO: 772939 - protein, 361 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSASCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 772940 - protein, 103 aa, Homo sapiens
ARSFRSQKSHNFPPCICPRRSLPVCPGEGKKGRHLVEPPYCVPGTLKPLSPHQDGINILSLINGETEALDKTSNSLQLVATPISEPQIFFYSREHVGIKYLTT

SEQ ID NO: 772941 - protein, 152 aa, Homo sapiens
LSYSLARRPSVGSHCLLSYLLLMNMIMIFLYLDNSTMRRMMAAANIYVCMYVCMYLETDSLSPRCSGAILAHCNLPLLDSSDSHASAPRVAGTTDAHHHTQLIFVFLVETRFYHVVQAGPEFLTSSDLPTPAFQSAEITGACLHTQPAANIY

SEQ ID NO: 772942 - protein, 491 aa, Homo sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 772943 - protein, 491 aa, Homo sapiens; identical to SEQ ID NO: 772942

SEQ ID NO: 772944 - protein, 258 aa, Homo sapiens
TPSCASGSHLSVPPIEKPIMFGFFANQNSLRNDTSSPLTNEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 772945 - protein, 298 aa, Homo sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGELPLTVKSGSMRFIFLCLMKQCS

SEQ ID NO: 772946 - protein, 89 aa, Homo sapiens
ATGICGPGPCPREVRKGPSLLSETMPKAGFCLGQFSTLVMGHFRVKMPPSHLTHSSTFIFSHEGDLCKEEEIARIARRLDKMVTKKSAS

SEQ ID NO: 772947 - protein, 113 aa, Homo sapiens
CAERPQPLGFSHRNNWKERKCLGQQQQQLSSDSAFRPAFLTKRKYRHGRLESLRHLGVVFHTCGVFVTITIVGKKTTQASFRIHSSVWVTCGFWLISAYLCAKESFLVNSPIT

SEQ ID NO: 772948 - protein, 230 aa, Homo sapiens
MGRDYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAARPKKPPVGTHSPLKLRRGGKISRPGCPVSEELKGWPNRETR

SEQ ID NO: 772949 - protein, 391 aa, Homo sapiens
RCSSDFRTSPWESRRVESKATSARCGLWGSGPRRRPASGMFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772950 - protein, 391 aa, Homo sapiens; identical to SEQ ID NO: 772949

SEQ ID NO: 772951 - protein, 356 aa, Homo sapiens
LVRGLGYSAEDWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772952 - protein, 391 aa, Homo sapiens; identical to SEQ ID NO: 772949

SEQ ID NO: 772953 - protein, 149 aa, Homo sapiens
LKKKLKRMILEYLALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772954 - protein, 159 aa, Homo sapiens
RCSSDFRTSPWESRRVESKATSARCGLWGSGPRRRPASGMFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQTDIKF

SEQ ID NO: 772955 - protein, 162 aa, Homo sapiens
RCSSDFRTSPWESRRVESKATSARCGLWGSGPRRRPASGMFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSGMV

SEQ ID NO: 772956 - protein, 391 aa, Homo sapiens; identical to SEQ ID NO: 772949

SEQ ID NO: 772957 - protein, 391 aa, Homo sapiens; identical to SEQ ID NO: 772949

SEQ ID NO: 772958 - protein, 352 aa, Homo sapiens
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772959 - protein, 316 aa, Homo sapiens
MLHPSSRPRRWLSLRRRSCSKRETRSSSTRPKTSAITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772960 - protein, 126 aa, Homo sapiens
RGYKDTEIREQIAAGEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 772961 - protein, 290 aa, Homo sapiens
RCSSDFRTSPWESRRVESKATSARCGLWGSGPRRRPASGMFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAGIFWVEDSTL

SEQ ID NO: 772962 - protein, 102 aa, Homo sapiens
MSKVLGGPFSKGHTASDKYFQIFHNISFFETESCSVAQAGVQWCNLGSLQALPPRFTPFSCLSLPSSWDYRHPPPCPDNVFVFSVETGFHCVSQDGLNLLTL

SEQ ID NO: 772963 - protein, 102 aa, Homo sapiens; identical to SEQ ID NO: 772962

SEQ ID NO: 772964 - protein, 80 aa, Homo sapiens
AAVDLGVDDAAVELGVDAAVDRGVDAAAVDGGVGDAAVDLDVDDAAVDLGVDAAVDRGVDDAAVDLGVDAAVDRGVDAAV

SEQ ID NO: 772965 - protein, 42 aa, Homo sapiens
DRLSSNFSWGPISLPFQKGRWDFNLKLNQLKNKGGVEMLFDL

SEQ ID NO: 772966 - protein, 93 aa, Homo sapiens
EWAELTRCGWESGRPENPALGSRPRPGWLGAGPSGFHSVFDPRSSLSGPAGRTTVTAAPAAARSFSGRRAQSAARRGRRHGCVLEELARQRRG

SEQ ID NO: 772967 - protein, 578 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 772968 - protein, 578 aa, Homo sapiens; identical to SEQ ID NO: 772967

SEQ ID NO: 772969 - protein, 337 aa, Homo sapiens
HELSLRISNRQSYQHKSSQYVLVNLPVEDCMEEPRSKLIPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 772970 - protein, 338 aa, Homo sapiens [sequence omitted]

SEQ ID NO: 772971 - protein, 204 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQILFPQLNLGLLNFEPKTLAPSPQKPPNFNPQAGLACRFS

SEQ ID NO: 772972 - protein, 338 aa, Homo sapiens [sequence omitted]

SEQ ID NO: 772973 - protein, 197 aa, Homo sapiens
MTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 772974 - protein, 238 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSVRGQSRLCENTYA

SEQ ID NO: 772975 - protein, 225 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKR

SEQ ID NO: 772976 - protein, 338 aa, Homo sapiens [sequence omitted]

SEQ ID NO: 772977 - protein, 382 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIWSGKVSYRCKSSAILSFEHFLFKGTAETMGLVLFPPLFFFTPLWGPRGCPTLVGARALYSGTGICNTRVTRGAKKEGET

SEQ ID NO: 772978 - protein, 281 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSR

SEQ ID NO: 772979 - protein, 120 aa, Homo sapiens
MCCVTALSFSHPGGAEMSLLRVQINTVKANRDQCKVLIVRKSSAQVQNGVLANGQQTIMILSSCDCHCRSLSTLQFIKFLHGWARWLTPVIPALWEAEEGGSQGQEFKTSLAKMVKPSLH

SEQ ID NO: 772980 - protein, 106 aa, Homo sapiens
LPCQNIGYFHYPKKFPPAPLQSNTSLPQLLATADLNCRPENVIQNPFHLDPSLCVNIAVSGVCGIFLDVLCHAPAPSFLPSGRHPCQESAALKWVFQGCLPLLSSH

SEQ ID NO: 772981 - protein, 41 aa, Homo sapiens
EIVPLDSSLGDRERLRLQKKKVQIHANKTWHNSLAQAIALR

SEQ ID NO: 772982 - protein, 91 aa, Homo sapiens
AGGEKRLLLVFPQQSRNKQTMATGPLCSEAQGSKGLNGAHGPGLGGQAQVWLCWDGSIAFRRAARPVGQEPDPQLDSGSWQAGRLLGQHAV

SEQ ID NO: 772983 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 772984 - protein, 417 aa, Homo sapiens; identical to SEQ ID NO: 772983

SEQ ID NO: 772985 - protein, 281 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSTLPQYG

SEQ ID NO: 772986 - protein, 385 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYL

SEQ ID NO: 772987 - protein, 397 aa, Homo sapiens
MRFAWTVLLLGPLQLCALVHCAPPAAGQQQPPREPPAAPGAWRQQIQWENNGQVFSLLSLGSQYQPQRRRDPGAADNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 772988 - protein, 417 aa, Homo sapiens; identical to SEQ ID NO: 772983

SEQ ID NO: 772989 - protein, 369 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDV

SEQ ID NO: 772990 - protein, 187 aa, Homo sapiens
MSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 772991 - protein, 235 aa, Homo sapiens
MDVSELCIPDPLGYHNQLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPCECQGS

SEQ ID NO: 772992 - protein, 521 aa, Homo sapiens
MDVSELCIPDPLGYHNQLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKAWARADSLQEWRPLEQVPSPLHRATKRQHVHFLTPLPPPPSVAWVGTAQAGYHLEVFLPQRAGWPRAA

SEQ ID NO: 772993 - protein, 120 aa, Homo sapiens
VGQEQLRGSPKDERMSSHDGKCPFQSAAFTSRDQSNSPGIPNPRPSSPTPLNERGRQISPSTRTPGGQVTFCSFSIEALVPPPWLYPRNLPAWASGLGRAEVIPDRREGWLKSTNCRAAL

SEQ ID NO: 772994 - protein, 817 aa, Homo sapiens
EYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQPGAHGALSSEMRRLGSLSRPGPPYVTVDWQWKLFLDTPALALTLGWKRNELGLQLRPFHGGILPFPGLVNEKFPEVKDFLFPAKMVSRTLRPEVIQCFGSCRSHRLLRGLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKAWARADSLQEWRPLEQVPSPLHRATKRQHVHFLTPLPPPPSVAWVGTAQAGYHLEVFLPQRAGWPRAA

SEQ ID NO: 772995 - protein, 216 aa, Homo sapiens
MDVSELCIPDPLGYHNQLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEELCCLIWQPPATRGSRVLVQTEVC

SEQ ID NO: 772996 - protein, 155 aa, Homo sapiens
AGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 772997 - protein, 118 aa, Homo sapiens
FLDLFDPDFHLGSPGFNRKNEEERAFIKYNLQKSKRKTKDITSLYFLIDWLGWKSVCKRLSTTNNKKGKHHCHTHANTSWSVLLFLFMFGGHFVVPIPMGRFCIPTLLNSSHIICFDQ

SEQ ID NO: 772998 - protein, 148 aa, Homo sapiens
HRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTEGEVSADEEGFENLWATASTFIVLFLLSLFYSTTVTLFKVK

SEQ ID NO: 772999 - protein, 73 aa, Homo sapiens
FLLSLFYSTTVTLFKVARLWHREEGAGRMWGPGSSLGWTSSPEAPTPPHWVISAPAPFPTTGKAFHTVSVACR

SEQ ID NO: 773000 - protein, 127 aa, Homo sapiens
HRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 773001 - protein, 69 aa, Homo sapiens
SKPMEGRGKKQDWAEEAKLQCKLRDGLNHSKGYFETKIVHQSCLRLGHNGWTFIRPLQSVIRCGPSWEG

SEQ ID NO: 773002 - protein, 133 aa, Homo sapiens
MMKQKFHVLPKAAWQQTWGPKPPNAKTPGTGSHPRLRTHLPGHPQDSRGDRPSSHCHRLACVSSVLSREESGTEAREGGLEEPGEAGWGAWISPPCCSRTPAKAQPSLGWLSFTWVGGAGGEILGLRGARVAA

SEQ ID NO: 773003 - protein, 103 aa, Homo sapiens
AFPSAVNIMTWGLQHPSSKPFPKKVKRSQDDWHLLLLLLFFLFPCPAPSCACVSDNTGASTGVENPAAQLSSAHRSLGNGLSLCNKKIFFFFLNLHYIFFDCL

SEQ ID NO: 773004 - protein, 113 aa, Homo sapiens
SSPPPRRSAPWRDSALRVPGEDSAVATSSVQASAFLSISPSSPRSSSPSVSKPVASRPPCRALCEDGGGEARRERPGFPARAERRGLQTRRGQVHHERVWAMFEDCPSIQFYE

SEQ ID NO: 773005 - protein, 105 aa, Homo sapiens
MICQPLYLLLFIASYPTVYTPSTLKYIVAPRIQHALWPQFLYTCYFLHLSPPLLTTDIEDSSQVSSNFPLPFLQTLKSELGTTNNMAETIVFQGPMRKKKTGFKI

SEQ ID NO: 773006 - protein, 83 aa, Homo sapiens
MSDNTTLPAPASNQGPTTPRKGPPKFKQRQTRQFKSKPPKKGVKGFGDDIPGMEGLGTDITVICPWEAFSHLELHELAQFGII

SEQ ID NO: 773007 - protein, 424 aa, Homo sapiens
MAAESDVLHFQFEQQGDVVLQKMNLLRQQNLFCDVSIYINDTEFQGHKVILAACSTFMRDQFLLTQSKHVRITILQSAEVGRKLLLSCYTGALEVKRKELLKYLTAASYLQMVHIVEKCTEALSKYLEIDLSMKNNNQHTDLCQSSDPDVKNEDENSDKDCEIIEISEDSPVNIDFHVKEEESNALQSTVESLTSERKEMKSPELSTVDIGFKDNEICILHVESISTAGVENGQFSQPCTSSKASMYFSETQHSLINSTVESRVAEVPGNQDQGLFCENTEGSYGTVSEIQNLEEGYSLRHQCPRCPRGFLHVENYLRHLKMHKLFLCLQCGKTFTQKKNLNRHIRGHMGIRPFQCTVCLKTFTAKSTLQDHLNIHSGDRPYKCHCCDMDFKHKSALKKHLTSVHGRSSGEKLSRPDLKRQSLL

SEQ ID NO: 773008 - protein, 424 aa, Homo sapiens; identical to SEQ ID NO: 773007

SEQ ID NO: 773009 - protein, 347 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGY

SEQ ID NO: 773010 - protein, 1246 aa, Homo sapiens [sequence omitted]

SEQ ID NO: 773011 - protein, 1246 aa, Homo sapiens [sequence omitted]

SEQ ID NO: 773012 - protein, 1290 aa, Homo sapiens
MSKERPKRNIIQKKYDDSDGIPWSEERVVRKVLYLSLKEFKNSQKRQHAEGIAGSLKTVNGLLGNDQSKGLGPASEQSENEKDDASQVSSTSNDVSSSDFEEGPSRKRPRLQAQRKFAQSQPNSPSTTPVKIVEPLLPPPATQISDLSKRKPKTEDFLTFLCLRGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIECPAESVCNFQLLTSVGSQQRLVVERERNQTRTAGSGQLPAGEQEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 773013 - protein, 1251 aa, Homo sapiens
MARTAARLPFRTRGGGEQRGDDSDGIPWSEERVVRKVLYLSLKEFKNSQKRQHAEGIAGSLKTVNGLLGNDQSKGLGPASEQSENEKDDASQVSSTSNDVSSSDFEEGPSRKRPRLQAQRKFAQSQPNSPSTTPVKIVEPLLPPPATQISDLSKRKPKTEDFLTFLCLRGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 773014 - protein, 1259 aa, Homo sapiens
IRSAFLHNTKAKSLTQATDGTLIRLAKKDDSDGIPWSEERVVRKVLYLSLKEFKNSQKRQHAEGIAGSLKTVNGLLGNDQSKGLGPASEQSENEKDDASQVSSTSNDVSSSDFEEGPSRKRPRLQAQRKFAQSQPNSPSTTPVKIVEPLLPPPATQISDLSKRKPKTEDFLTFLCLRGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 773015 - protein, 545 aa, Homo sapiens
GWLYKRSAADRRTEILYNTQGVVVKPDSRTTYHHVPPSAQAIEPNKWSHSYGRLLPTEQAFLQAIASTDACSLESDIKRLGGPSYYTTLGDKEVVLAVGAQTYIGFIMSSIVLYEGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 773016 - protein, 283 aa, Homo sapiens
MKTAGVPAHREGCLSLALSPQISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 773017 - protein, 1040 aa, Homo sapiens
MSKERPKRNIIQKKYDDSDGIPWSEERVVRKVLYLSLKEFKNSQKRQHAEGIAGSLKTVNGLLGNDQSKGLGPASEQSENEKDDASQVSSTSNDVSSSDFEEGPSRKRPRLQAQRKFAQSQPNSPSTTPVKIVEPLLPPPATQISDLSKRKPKTEDFLTFLCLRGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIECPAESVCNFQLLTSVGSQQRLVVERERNQTRTAGSGQLPAGEQEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMVRPLSHRLQQEL

SEQ ID NO: 773018 - protein, 83 aa, Homo sapiens
PPDWRPECKLNDEMRFVTQIQHIHKLGRRWGPNVQRLACIKKHLKSQGITMDELPLIGRSGRGVRGWCLPSCPQIPAVPSQSS

SEQ ID NO: 773019 - protein, 86 aa, Homo sapiens
DVMYLSVCPLFSPVGLLGNDQSKGLGPASEQSENEKDDASQVSSTSNDVSSSDFEEGPSRKRLVPKAENIGTFNQGLQTQVPVFTT

SEQ ID NO: 773020 - protein, 184 aa, Homo sapiens
MVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPRGL

SEQ ID NO: 773021 - protein, 182 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVGGLLLLTQSPLTFSPLSNWKICCPAAVSRAVAGDSGS

SEQ ID NO: 773022 - protein, 447 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATISPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 773023 - protein, 367 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 773024 - protein, 184 aa, Homo sapiens; identical to SEQ ID NO: 773020

SEQ ID NO: 773025 - protein, 258 aa, Homo sapiens
MGVFPEAATKPLLSMGWCGKSLSACGSAGAPVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPRGL

SEQ ID NO: 773026 - protein, 261 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPRGL

SEQ ID NO: 773027 - protein, 208 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVASPGQWRETRALESTTCFMEKEGVAGPRSPGCPETSLGALFVFSASLKAQESQKWFHLINICF

SEQ ID NO: 773028 - protein, 184 aa, Homo sapiens; identical to SEQ ID NO: 773020

SEQ ID NO: 773029 - protein, 238 aa, Homo sapiens
GGAVASLPRGEVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPRGL

SEQ ID NO: 773030 - protein, 19 aa, Homo sapiens
MSQKTCFIETSRKLQTKKT

SEQ ID NO: 773031 - protein, 274 aa, Homo sapiens
EHLPFFQPTARSLTSLLGTMSTCSHQFTSSRSMKGSCSIGGSIGGGSSRISSVLAGGSCHAPSTYGGACVSPSLSFSFGGACGLGGGYGGGFGSSSSFASGFGGGYGGGLGAGFGGGLGAGLGGGFAGGDGLLVGSEKVTMQHLGDRLASYLDKVRALEEANADLEVKIRDWYQRQRPSEIKDYSPYFKTIEDLRHKIIAATIENAQPILQIDNARLAADDFRTNEEHELALRLTVEAGVNGLCRVLDELTLARTDLEMQIEGLKEELAYLRKN

SEQ ID NO: 773032 - protein, 102 aa, Homo sapiens
MAGCRSRALPARRQLRPGEKLSTAAAGPTAKPLTALGPAGSAAAPSAGPTEPTATWNARWPTSNARSPGSHPRLSFHTSAQAEGAGSGLGQPRKRSHSAAAG

SEQ ID NO: 773033 - protein, 180 aa, Homo sapiens
GSGWHASALPFYLCRCCFSPERLPATCTNPTATLPMPPHSLVLPVPCTHQELARGPGRWVLLTACSQCPVHNMGLKIQAMNQGYTSTGNLSIRLGLRLQVCTALSTGCFPGGPGALQMLSFQCTRSLPQPPPWALGTSTSLSEVASPRPEPSSDLGTSPPAFRKYQGALLLAEGMDHSSS

SEQ ID NO: 773034 - protein, 347 aa, Homo sapiens
MSFVLSRMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 773035 - protein, 347 aa, Homo sapiens; identical to SEQ ID NO: 773034

SEQ ID NO: 773036 - protein, 347 aa, Homo sapiens; identical to SEQ ID NO: 773034

SEQ ID NO: 773037 - protein, 350 aa, Homo sapiens
MPILSSSGSKMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 773038 - protein, 323 aa, Homo sapiens
MSFVLSRMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTPVRNLLTLFWNRCQTVAFNLIKIK

SEQ ID NO: 773039 - protein, 347 aa, Homo sapiens; identical to SEQ ID NO: 773034

SEQ ID NO: 773040 - protein, 347 aa, Homo sapiens; identical to SEQ ID NO: 773034

SEQ ID NO: 773041 - protein, 278 aa, Homo sapiens [sequence omitted]

SEQ ID NO: 773042 - protein, 138 aa, Homo sapiens
FFLEMESHSVAQAGVQTEQETRRPRLGVGVAGGKRRQKREREWEKTQKETIGGATQHPPPRAKTKIKKPPRENPRAVTAETGGENLSRDIAKQERTARKRPGVYELVSVIEPSRRKNHSDRVLSLSLPNTERRTIING

SEQ ID NO: 773043 - protein, 139 aa, Homo sapiens [sequence omitted]

SEQ ID NO: 773044 - protein, 227 aa, Homo sapiens
MQDERSGPGQPAADPEPTGPRPAPPTAPRSRSRPHHPRPPSPTGHARPALKRGGGVPLRPGPALAPPGPPPGAGAMAFTFAAFCYMLTLVLSISLIFFVIWHIIAFDELRTDFKNPIDQGTLLRARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYR

SEQ ID NO: 773045 - protein, 235 aa, Homo sapiens
MQDERSGPGQPAADPEPTGPRPAPPTAPRSRSRPHHPRPPSPTGHARPALKRGGGVPLRPGPALAPPGPPPGAGAMAFTFAAFCYMLTLVLSISLIFFVIWHIIAFDELRTDFKNPIDQGTLLRARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 773046 - protein, 227 aa, Homo sapiens; identical to SEQ ID NO: 773044

SEQ ID NO: 773047 - protein, 156 aa, Homo sapiens
RLLPGRADSAAEIALAPPMAAHVERWELLQYLLLRHPIAAFSFPQQRERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 773048 - protein, 235 aa, Homo sapiens; identical to SEQ ID NO: 773045

SEQ ID NO: 773049 - protein, 148 aa, Homo sapiens
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 773050 - protein, 112 aa, Homo sapiens
MLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 773051 - protein, 148 aa, Homo sapiens; identical to SEQ ID NO: 773049

SEQ ID NO: 773052 - protein, 112 aa, Homo sapiens; identical to SEQ ID NO: 773050

SEQ ID NO: 773053 - protein, 648 aa, Homo sapiens [sequence omitted]

SEQ ID NO: 773054 - protein, 133 aa, Homo sapiens
MVELIFIPTNSDSRSAKEEQRVIHLNHVQEMIRSRCGVSQLFSFVPHFLTQHFKLPKVRKRKKAKGKKVVLTLAVLKKQETMKVVNLPFEKFGTGQDILALDRTSSPKGTSLALSNGPIILGCSSREPSSISS

SEQ ID NO: 773055 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773056 - protein, 571 aa, Homo sapiens
RWKYEETLQLRWRWRPLQLRAAWPGRTRPEAEGRARAQLPGHQIGARRAGGPRAGLEMSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773057 - protein, 546 aa, Homo sapiens
LYQFQLFTLPAGQDLAQPLFIQSANQPSDGQCPPGDLVTDGPELAGQGHPTQFWPYSPRQWAQPSSPEDPADLSASCRLGHWCTSCRDSNLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773058 - protein, 326 aa, Homo sapiens
MPAGHGARGSRLKPRPGPAAPGRRRRAERAPSCPGTKSERGVREGPEQDWKCPGRAASCSDTCSRPSCFTNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773059 - protein, 514 aa, Homo sapiens; identical to SEQ ID NO: 773055

SEQ ID NO: 773060 - protein, 514 aa, Homo sapiens; identical to SEQ ID NO: 773055

SEQ ID NO: 773061 - protein, 114 aa, Homo sapiens
VICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKVPQSSVF

SEQ ID NO: 773062 - protein, 514 aa, Homo sapiens; identical to SEQ ID NO: 773055

SEQ ID NO: 773063 - protein, 409 aa, Homo sapiens
ASSDLRLAAVALPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773064 - protein, 304 aa, Homo sapiens
MSFSPQREPRRSLCGLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773065 - protein, 198 aa, Homo sapiens
MAATGAQIHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 773066 - protein, 230 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLLFLPKISFLITMHFKDKQF

SEQ ID NO: 773067 - protein, 227 aa, Homo sapiens
MRHEAPMQMASAQDARYGQKDSSDQNFDYMFKLLIIGNSSVGKTSFLFRYADDSFTSAFVSTVGIDFKVKTVFKNEKRIKLQIWDTAGQERYRTITTAYYRGAMGFILMYDITNEESFNAVQDWSTQIKTYSWDNAQVILVGNKCDMEDERVISTERGQHLGEQLGFEFFETSAKDNINVKQTFERLVDIICDKMSESLETDPAITAAKQNTRLKETPPPPQPNCAC

SEQ ID NO: 773068 - protein, 227 aa, Homo sapiens; identical to SEQ ID NO: 773067

SEQ ID NO: 773069 - protein, 144 aa, Homo sapiens [sequence omitted]

SEQ ID NO: 773070 - protein, 169 aa, Homo sapiens
WKPRSVLLSSWVVQGRRWPCSRVLAGWGHRSHPSALPGVSGGGQFRQQKPGWDQANLVWVGGLRPWRWPPSPCSLPWVSALPSLGHPPLPLLSQRTPIPDSSEFWKCFLRLIYGSDRWWRGAGGGRDGRCGEGRWKLLCHLGWGLPPSPRRPKGDPFLFSSHQELGWSL

SEQ ID NO: 773071 - protein, 350 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 773072 - protein, 323 aa, Homo sapiens
MCVSSFYSNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 773073 - protein, 308 aa, Homo sapiens
LGGQEVEFIGEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 773074 - protein, 404 aa, Homo sapiens
VTQAGVQWRNLSSLQPPPPWFKRFSCLLRPTPRVPRRAAAATLCAPRRPPVPPAMPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 773075 - protein, 350 aa, Homo sapiens; identical to SEQ ID NO: 773071

SEQ ID NO: 773076 - protein, 48 aa, Homo sapiens
QHKPVDDGSYHLLDQRSQQWRLWGIPRQPARALRVPPERFQTAHAPHH

SEQ ID NO: 773077 - protein, 231 aa, Homo sapiens
MRCSAEAARGTTATLFRTWGPQLGGLPNVRGPIYLKKVPFYGHKYDLTSSRQTVVLACCHSFHIKRLMKFVHRFSTGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 773078 - protein, 357 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 773079 - protein, 353 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGECGPFPHRVPVDQECSSCIPLPSCGAGDWRGKRWWQCFRVERSFQLILIFFFFGSQEPKVMP

SEQ ID NO: 773080 - protein, 224 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRPRCPLPSLHCFSSLPSAVIDAKEWGGGGKWEATVAYRKKKIYPVHIFNM

SEQ ID NO: 773081 - protein, 52 aa, Homo sapiens
MKPKCTCNTHLRRNSKSVRCPNRSEMEKRTPTQEFPPSQYDAPTSMKRRNAH

SEQ ID NO: 773082 - protein, 92 aa, Homo sapiens
PGSGSRGVKVLPRRVSFALPWIKSALPRSPALLPLGRGIPTDLEILACLPFTQSKLRRPEEDQGSLLGLPGNHMGISHTSFLLTSEHLRITW

SEQ ID NO: 773083 - protein, 129 aa, Homo sapiens
PGSGSRGVKVLPRRVSFALPWIKSALPRSPALLPLGRGIPTDLEILACLPFTQSKLRRPASPLSSTILCPVVSSAVSWVIKQASPPSGVHEWLSKPPNTFPCSLHISDEGDYVLPETAELDSMYFKFVK

SEQ ID NO: 773084 - protein, 109 aa, Homo sapiens
MYTLPIAYFSCSKHFSDYSRPVLFKVLTREVDSSPGRLPASPQLAPGARRPGPSPGEAASSAWSWDPAGPTFVLGCRRPPRPSWCRALLLPKSSLPLSQGWGGSQGLVL

SEQ ID NO: 773085 - protein, 83 aa, Homo sapiens
PGSGSRGVKVLPRRVSFALPWIKSALPRSPALLPLGRGIPTDLEILACLPFTQSKLRRPGEDQGSYVAFSNHMGSANVFSTRH

SEQ ID NO: 773086 - protein, 509 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 773087 - protein, 510 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIDLCDLYLVPTSYLIL

SEQ ID NO: 773088 - protein, 509 aa, Homo sapiens; identical to SEQ ID NO: 773086

SEQ ID NO: 773089 - protein, 131 aa, Homo sapiens
SGRRRAIRSSAAAGTMVGGEAAAAVEELVSGVRQAADFAEQFRSYSESEKQWKARMEFILRHLPDYRDPPDGSGRLDQLLSLSMVWANHLFLGCSYNKDLLDKVMEMADGIEVEDLPQFTTRSELMKKHQS

SEQ ID NO: 773090 - protein, 131 aa, Homo sapiens; identical to SEQ ID NO: 773089

SEQ ID NO: 773091 - protein, 102 aa, Homo sapiens
SGRRRAIRSSAAAGTMVGGEAAAAVEELVSGVRQAADFAEQFRSYSESEKQWKARMEFILRHLPDYRDPPDGSGRLDQLLSLSMVWANHLFLGCRCGPLPAG

SEQ ID NO: 773092 - protein, 131 aa, Homo sapiens; identical to SEQ ID NO: 773089

SEQ ID NO: 773093 - protein, 131 aa, Homo sapiens; identical to SEQ ID NO: 773089

SEQ ID NO: 773094 - protein, 100 aa, Homo sapiens
SGRRRAIRSSAAAGTMVGGEAAAAVEELVSGVRQAADFAEQFRSYSESEKQWKARMEFILRHLPDYRDPPDGSGRLDQLLSLSMVWANHLFLGCSPRGPK

SEQ ID NO: 773095 - protein, 131 aa, Homo sapiens; identical to SEQ ID NO: 773089

SEQ ID NO: 773096 - protein, 124 aa, Homo sapiens
AFLFTLCSPTGGKKLHRLESDQARESPDHHLKRLATRGLSKGGCWFVLQGFHFFDLEQESANRHCQAKSRPLPVFVNKTSWGRAVPVCSCLWLLLWYLIRVNAVVTEAIWLVKPKRSTVLARHT

SEQ ID NO: 773097 - protein, 420 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 773098 - protein, 210 aa, Homo sapiens
GRQARRGPNWRGCWGCSGTVGAAPQAQVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 773099 - protein, 404 aa, Homo sapiens
GRQARRGPNWRGCWGCSGTVGAAPQAQVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 773100 - protein, 464 aa, Homo sapiens
MVRILWIEPAAAMDAPARLLAPLLLLCAQQLRGTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLGITTVLTMTTLMVSARSSLPRASAIKALDVYFWICYVFVFAALVEYAFAHFNADYRKKQKAKVKVSRPRAEMDVRNAIVLFSLSAAGVTQELAISRRQRRVPGNLMGSYRSVGVETGETKKEGAARSGGQGGIRARLRPIDADTIDIYARAVFPAAFAAVNVIYWAAYAM

SEQ ID NO: 773101 - protein, 481 aa, Homo sapiens
AGLAPARLCRLCGRREPSLRGPRPEPAAAMDAPARLLAPLLLLCAQQLRGTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLGITTVLTMTTLMVSARSSLPRASAIKALDVYFWICYVFVFAALVEYAFAHFNADYRKKQKAKVKVSRPRAEMDVRNAIVLFSLSAAGVTQELAISRRQRRVPGNLMGSYRSVGVETGETKKEGAARSGGQGGIRARLRPIDADTIDIYARAVFPAAFAAVNVIYWAAYAM

SEQ ID NO: 773102 - protein, 98 aa, Homo sapiens
PFLELSRCQGPTPPSRNPVTRCDMQLCCPSSEQRRTWTYRQESPPQGVRYSEERNANQLLSPFCLVDFLAEWCTVHGRFHLAGPGSLVSSVVHTNSKH

SEQ ID NO: 773103 - protein, 41 aa, Homo sapiens
MSSSRVGPGRSEYSFQMLAIRTPAQRAVFGNIAPAEVLPAP

SEQ ID NO: 773104 - protein, 289 aa, Homo sapiens
GRSRSGSWSRSGAERSGAGAERAERAEPAAELGARAGGMYRARAARAGPEPGSPGRFGILSTGQLRDLLQDEPKLDRIVRLSRKFQGLQLEREACLASNYALAKENLALRPRLEMGRAALAIKYQELREVAENCADKLQRLEESMHRWSPHCALGWLQAELEEAEQEAEEQMEQLLLGEQSLEAFLPAFQRGRALAHLRRTQAEKLQELLRRRERSAQPAPTSAADPPKSFPAAAVLPTGAARGPPAVPRSLPPLDSRPVPPLKGSPGCPLGPAPLLSPRPSQPEPPHR

SEQ ID NO: 773105 - protein, 199 aa, Homo sapiens
ISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 773106 - protein, 139 aa, Homo sapiens
RPPPPPPPPPLPESPLGGRRVSPTPPASGRGPQSAASPVETGPPVPVRRERAPDSARCERAGKGCEDSLFGSSNGFLGPRRAGFQACHGLQCGRDERSSLEFSPRLGTARWVARRPRSIGKGGWRLPERAQPGSPATTL

SEQ ID NO: 773107 - protein, 119 aa, Homo sapiens
KCSLTTAGDFPSHQDFRGTPQVQPLRLLRNQSLAWSQLGQRRGARLGGLGVWLGLLRGSSSQSPHDLLVTGLKSGPRPIPTLNPELPETWLARTGPNFYRGLRGMEKGSLPLPFSVTPP

SEQ ID NO: 773108 - protein, 110 aa, Homo sapiens
MTFWFYENSFDFPDPLKVSQTPQTSSDYTLRPPFLFLFLFGDGVSLLSPKLERNGTISAHYSLHLPGSSDSPTSASRAAGITVMRHHAQLVFVCLAETGFHHVGQAGLEL

SEQ ID NO: 773109 - protein, 285 aa, Homo sapiens
GRGREKRARAKTESRRKAKGAVSNRRRREGSPPRCNIEKAPAGRMRTADGGEPAGASSPAGRVDGGLQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773110 - protein, 388 aa, Homo sapiens
MPQLSQDNQECLQKHFSRPSIWTQFLPLFRAQRYNTDIHQITENEGDLRAVPDIKSFPPAQLPDSPAAPKLFGLLSSPLSSLARFFSHLLRRPPPEAPRRRLDFSPLLPALPAARLSRGHEELPGRLSLLLGAALALPGRPSGGRPLRPPHPVAKPREEDATAGQSSPMPQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773111 - protein, 180 aa, Homo sapiens
MKETSGLFLISSLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773112 - protein, 79 aa, Homo sapiens
GRGREKRARAKTESRRKAKGAVSNRRRREGSPPRCNIEKAPAGRMRTADGGEPAGASSPAGRVDGGLGLCMHHHIWLIK

SEQ ID NO: 773113 - protein, 273 aa, Homo sapiens
MPQLSQDNQECLQKHFSRPSIWTQFLPLFRAQRYNTDIHQITENEGDLRAVPDIKQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773114 - protein, 152 aa, Homo sapiens
MKETSGLFLISSPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773115 - protein, 122 aa, Homo sapiens
MVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 773116 - protein, 214 aa, Homo sapiens
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENLAPISNEVS

SEQ ID NO: 773117 - protein, 333 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSWESTEMICAILEIPVYKSRIQSSICSFPLSRIQNSQDLKSREEKIIFIHAAPVKWELLSETSSVLGGWPASMQCEMSGSRVGVVALKKYNGCGDRKYA

SEQ ID NO: 773118 - protein, 384 aa, Homo sapiens
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSWRVHEMICAILEIPVYKSRIQSSICSFPLSRIQNSQDLKSREEKIIFIHAAPVKWELLSETSSVLGGWPASMQCEMSGSRVGVVALKKYNGCGDRKYA

SEQ ID NO: 773119 - protein, 289 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGDNKGSRRSQYY

SEQ ID NO: 773120 - protein, 440 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 773121 - protein, 109 aa, Homo sapiens
MNYSLHLAFVCLSLFTERMCIQGSQFNVEVGRSDKLSLPGFENLTAGYNKFLRPNFGGEPVQIALTLDIASISSISESNMVSAVPLYSTQVVPLCVFKGDMLSSRSKKK

SEQ ID NO: 773122 - protein, 112 aa, Homo sapiens [sequence omitted]

SEQ ID NO: 773123 - protein, 440 aa, Homo sapiens; identical to SEQ ID NO: 773120

SEQ ID NO: 773124 - protein, 371 aa, Homo sapiens
MVTQRSSAKAHCYGVSVYRLFPALIHRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 773125 - protein, 349 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRQKICYLYAA

SEQ ID NO: 773126 - protein, 75 aa, Homo sapiens
AATPLLPTENGEGRLRVIVGREADSSSEACVGLEPPQDVTETSWQIEINEAKRKLMENILLYKEEKVDSIELFGP

SEQ ID NO: 773127 - protein, 1908 aa, Homo sapiens
RPSTRQRPRPPSPPRFSLPLRRAPASLSAARTAARALTRAAMEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIALSPTTAMPFRGYAVLGGERGGPEVQQVPAGERPLWFICSGMGTQWRGMGLSLMRLDRFRDSILRSDEAVNRFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIRRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARPLGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTSHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPSGHVAFLTSTEPQYGQGILSQDAWESLFSRVSVRLVGLKKSFYGSTLFLCRRPTPQDSPIFLPVDDTSFRWVESLKGILADEDSSRPVWLKAINCATSGVVGLVNCLRREPGGTLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPARHGYLPEERDIPRATQACWLRPPLGQALAQPAEWGVVGQSPRSWAPAQAHRARPHPAAPRTATRGVLPLCPAPGTNSMFGVCLCLFFKK

SEQ ID NO: 773128 - protein, 2550 aa, Homo sapiens
RPSTRQRPRPPSPPRFSLPLRRAPASLSAARTAARALTRAAMEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIALSPTTAMPFRGYAVLGGERGGPEVQQVPAGERPLWFICSGMGTQWRGMGLSLMRLDRFRDSILRSDEAVNRFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIRRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARPLGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTSHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPSGHVAFLTSTEPQYGQGILSQDAWESLFSRVSVRLVGLKKSFYGSTLFLCRRPTPQDSPIFLPVDDTSFRWVESLKGILADEDSSRPVWLKAINCATSGVVGLVNCLRREPGGTLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 773129 - protein, 2550 aa, Homo sapiens; identical to SEQ ID NO: 773128

SEQ ID NO: 773130 - protein, 2274 aa, Homo sapiens
RPSTRQRPRPPSPPRFSLPLRRAPASLSAARTAARALTRAAMEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIALSPTTAMPFRGYAVLGGERGGPEVQQVPAGERPLWFICSGMGTQWRGMGLSLMRLDRFRDSILRSDEAVNRFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIRRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARPLGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTSHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPSGHVAFLTSTEPQYGQGILSQDAWESLFSRVSVRLVGLKKSFYGSTLFLCRRPTPQDSPIFLPVDDTSFRWVESLKGILADEDSSRPVWLKAINCATSGVVGLVNCLRREPGGTLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQSHPSLLAAAPSRPGIGSAR

SEQ ID NO: 773131 - protein, 390 aa, Homo sapiens
MNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEK

SEQ ID NO: 773132 - protein, 754 aa, Homo sapiens
MNCYLLLRFMLGIPLLWPCLGATERGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 773133 - protein, 772 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 773134 - protein, 717 aa, Homo sapiens
MNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 773135 - protein, 207 aa, Homo sapiens
MVSSPCTPASSRTCSRILGLSLGTAALFAAGANVALLLPNWDVTYLLRGLLGRHAMLGTGLWGGGLMVLTALLSGGLALLGALICFVTSGVALKDGPFCMFDVSSFNQTQAWKYGYPFKDLHSRNYLYERFVWNSLLEPECVWTCAFFAFVIRWQVLWGVCIKAPGRLDLGSRGINSGGTRREVKEGEEKRGGGRKRGQRTDTRRNK

SEQ ID NO: 773136 - protein, 149 aa, Homo sapiens
ARGLQRGGRAALLPWRRFPCCRPRPQPARPSSRATPGPRSPGMATSIGVSFSVGDGVPEAEKNAGEPENTYILRPVFQQRRVEDGLWRGDLERAGLRGGARLGPGPRKERGGRAGSAGREAGGREAGGRPCCDVRAPLPLQGPQGTPPA

SEQ ID NO: 773137 - protein, 209 aa, Homo sapiens
MVSSPCTPASSRTCSRILGLSLGTAALFAAGANVALLLPNWDVTYLLRGLLGRHAMLGTGLWGGGLMVLTAAILISLMGWRYGCFSKSGLCRSVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 773138 - protein, 184 aa, Homo sapiens
ARGLQRGGRAALLPWRRFPCCRPRPQPARPSSRATPGPRSPGMATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVFMASRCFWDADTDNYTHDVFMNDSLFCVVAAFGCFYY

SEQ ID NO: 773139 - protein, 184 aa, Homo sapiens; identical to SEQ ID NO: 773138

SEQ ID NO: 773140 - protein, 209 aa, Homo sapiens; identical to SEQ ID NO: 773137

SEQ ID NO: 773141 - protein, 183 aa, Homo sapiens [sequence omitted]

SEQ ID NO: 773142 - protein, 135 aa, Homo sapiens
LFSPSFFFYFWDGVSPCLPGWSCSELRLHHCTPALVTEQDSVSKTKTNHKLGDLETTEISHTPGGWEVQDQGRHWQIWHLVRESFWFVDGPSSVLTWWKELALCGLFYVGANFNLPKAPPLNIITLRLRISTYEF

SEQ ID NO: 773143 - protein, 173 aa, Homo sapiens
QAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 773144 - protein, 150 aa, Homo sapiens [sequence omitted]

SEQ ID NO: 773145 - protein, 209 aa, Homo sapiens
SVTHRAGQAGQPWLRHSSGLLSSWVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTVVPGPALTSSSLLCPHHEWHIPPADSSSWPSWNPGSKQAGRGGGVG

SEQ ID NO: 773146 - protein, 399 aa, Homo sapiens
LCHSPGGPGRAAMAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 773147 - protein, 263 aa, Homo sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 773148 - protein, 129 aa, Homo sapiens
MCLSLSPHKWWGGPQGGSEAVPGCTPGQLTPRADDSPPVPPASRWSTTAPSTGTQRSCGRWRPAARCPGHSPPCPCSMCTQVSGCLPAWTAPRCPSFWTSTDSPASGSRSSPDFILPSLSTPRVAHPTC

SEQ ID NO: 773149 - protein, 161 aa, Homo sapiens
MSVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 773150 - protein, 510 aa, Homo sapiens
IRGRVDGAPTGPAGRPRDAPPGPSPPGARRSPTSSKFNHYLNPKGNEQTSRIGCQGLLRAGAEQALGVTVGDSGSRDSWGAVGKVPDHHAALISVKSKKAHSYHQPRSPGPDYSLRLENVPAPSRADSTSNAGGAKAEPRDRLSPESQLTEAPDRASASPRQLRSSVCERSSEFEDFWRPPSPSASPASEKSMCPSLDEAQPFPLPFKPYSWSGLAGSDLRHLVQSYRPCGALERGAGLGLFCEPAPEPGHPAALYGPKRAAGGAGAGAPGNCIAGAGATAGPGLGLYGDFGSAAAGLYEKPTAAAGLLYPERGHRLHANKGAGVKVESELLCTRLLLGGGSYKCIKCSKVFSTPHGLEVHVRRSHSGTRPFACEMCGKTFGHAVSLEQHKAVHSQERSFDCKICGKSFKRSSTLSTHLLIHSDTRPYPCQYCGKRFHQKSDMKKHTFIHTGEKPHKCQVCGKAFSQSSNLITHSRKHTGFKPFGCDLCGKGFQRKVDLRRHRETQHGLK

SEQ ID NO: 773151 - protein, 1320 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFNMTVLNSNAPPAVTTSNKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPRGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 773152 - protein, 507 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPGKDDFNFNLLVYE

SEQ ID NO: 773153 - protein, 212 aa, Homo sapiens
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYL

SEQ ID NO: 773154 - protein, 71 aa, Homo sapiens
MLFKLLQRQTYTCLSHRYGLYVCFLGVVVTIVSAFQFGEVVLEWSRDQYHVLFDSYRDNIAGKSFQNRSVR

SEQ ID NO: 773155 - protein, 56 aa, Homo sapiens
MGEHGMNSAHTLYSGWKQNENPTPLAGDVEGQGRRKVLGPGLRGQGDQQKTAGRAG

SEQ ID NO: 773156 - protein, 106 aa, Homo sapiens
TLRGRYIILLYTGSNSVSENECPSGACECDLIWKYGICRCNQVKIRSYWISVGPNPVTDMAKSRSPHSYSLAGAISATQLFMFLSSRSPSLLPLFQVSLACAWTIA

SEQ ID NO: 773157 - protein, 109 aa, Homo sapiens
RPSLGVLPSLYTFRSVGTFNIIVTAENEVGSAQDSIFVYVLQLIEGLQVVGGGRYFPTNHTVQLQAVVRDGTNIYSWTAWRDRGPALAGSGKGFSLTALEAGTYHVQLR

SEQ ID NO: 773158 - protein, 104 aa, Homo sapiens
TQMQMVSIFYGEERTSQRTKSPQFRVKRCGEEWTRETFRGSGKRQCTEEPLSRNQVTPSQRIFPGLRVGQPVNLCSTRLQNDNEAVILCASHWNRNTDFHFLPL

SEQ ID NO: 773159 - protein, 68 aa, Homo sapiens
AGSSVVDTPVIMLVWERFQSLAIAPTEAPFCTLLLPCTSQTRAFRAGTFIALPSPRLPNDNIQLSRSA

SEQ ID NO: 773160 - protein, 84 aa, Homo sapiens
SQAHSLQLRWGSGCGSCSHVGEADRTFLSPIAQHPPVCHVETHLGMQVANSSEEDELVWSKWDVDVKFILCCAKYHRVSHLPHQ

SEQ ID NO: 773161 - protein, 105 aa, Homo sapiens
MSFWRGFRKLTIIAEGQGKTVTSYMARPGAKGGATHFSMTRSQGSLLTISTTAPKVDGVETMRNHPCDAVTSHKAPSPTWRITSLHEIWVGMQIEMISPGVRRRG

SEQ ID NO: 773162 - protein, 530 aa, Homo sapiens
PPPPQPQPPQQPSPPPQQPPPPPPQPPQQQQPPPQAPPMEPEAPDSRKRPLETPPEVVCTKRSNTGEEGEYFLKVLIPSYAAGSIIGKGGQTIVQLQKETGATIKLSKSKDFYPGTTERVCLVQGTAEALNAVHSFIAEKVREIPQAMTKPEVVNILQPQTTMNPDRAKQAKLIVPNSTAGLIIGKGGATVKAVMEQSGAWVQLSQKPEGINLQERVVTVSGEPEQVHKAVSAIVQKVQEDPQSSSCLNISYANVAGPVANSNPTGSPYASPADVLPAAAAASAAAASGLLGPAGLAGVGAFPAALPAFSGTDLLAISTALNTLASYGYNTNSLGLGLNSAAASGVLAAVAAGANPAAAAAANLLASYAGEAGAGPAGGAAPPPPPPPGALGSFALAAAANGYLGAGAGGGAGGGGGPLVAAAAAAGAAGGFLTAEKLAAESAKELVEIAVPENLVGAILGKGGKTLVEYQELTGARIQISKKGEFLPGTRNRRVTITGSPAATQAAQYLISQRVTYEQGVRASNPQKVG

SEQ ID NO: 773163 - protein, 516 aa, Homo sapiens
MTVGWYLHFSVPLCASVSSCVKMELIPPASPGGCEEQDEIKLTKHSAQRLIKKEGEYFLKVLIPSYAAGSIIGKGGQTIVQLQKETGATIKLSKSKDFYPGTTERVCLVQGTAEALNAVHSFIAEKVREIPQAMTKPEVVNILQPQTTMNPDRAKQAKLIVPNSTAGLIIGKGGATVKAVMEQSGAWVQLSQKPEGINLQERVVTVSGEPEQVHKAVSAIVQKVQEDPQSSSCLNISYANVAGPVANSNPTGSPYASPADVLPAAAAASAAAASGLLGPAGLAGVGAFPAALPAFSGTDLLAISTALNTLASYGYNTNSLGLGLNSAAASGVLAAVAAGANPAAAAAANLLASYAGEAGAGPAGGAAPPPPPPPGALGSFALAAAANGYLGAGAGGGAGGGGGPLVAAAAAAGAAGGFLTAEKLAAESAKELVEIAVPENLVGAILGKGGKTLVEYQELTGARIQISKKGEFLPGTRNRRVTITGSPAATQAAQYLISQRVTYEQGVRASNPQKVG

SEQ ID NO: 773164 - protein, 368 aa, Homo sapiens
PSLLLPTQAKLIVPNSTAGLIIGKGGATVKAVMEQSGAWVQLSQKPEGINLQERVVTVSGEPEQVHKAVSAIVQKVQEDPQSSSCLNISYANVAGPVANSNPTGSPYASPADVLPAAAAASAAAASGLLGPAGLAGVGAFPAALPAFSGTDLLAISTALNTLASYGYNTNSLGLGLNSAAASGVLAAVAAGANPAAAAAANLLASYAGEAGAGPAGGAAPPPPPPPGALGSFALAAAANGYLGAGAGGGAGGGGGPLVAAAAAAGAAGGFLTAEKLAAESAKELVEIAVPENLVGAILGKGGKTLVEYQELTGARIQISKKGEFLPGTRNRRVTITGSPAATQAAQYLISQRVTYEQGVRASNPQKVG

SEQ ID NO: 773165 - protein, 203 aa, Homo sapiens
MTVGWYLHFSVPLCASVSSCVKMELIPPASPGGCEEQDEIKLTKHSAQRLIKKEGEYFLKVLIPSYAAGSIIGKGGQTIVQLQKETGATIKLSKSKDFYPGTTERVCLVQGTAEALNAVHSFIAEKVREIPQAMTKPEVVNILQPQTTMNPDRAKQVSWGRDWVAVKLLTFTKKHSSHITAYCEVQWDKADKNLISQRPHGSG

SEQ ID NO: 773166 - protein, 33 aa, Homo sapiens
MRTVASTCWMPHSRCPFEFFKSLPPHVIVLMTF

SEQ ID NO: 773167 - protein, 37 aa, Homo sapiens
MDAGPLIKDISNAYLPHCSSQPAGVSSVSCTIAPAAL

SEQ ID NO: 773168 - protein, 280 aa, Homo sapiens
GRRARRAAPPSWRAVGAGARPLRGPPAAGELPGTRGFQRGKKVAPAPGAARSADAAFRAKVRRGRAGGRAGSGGSFPHQRRSLPVGGTSGVIVEETAAPSPAGLFLGVRGASPALGACGVSQPRGPERTMRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDK

SEQ ID NO: 773169 - protein, 112 aa, Homo sapiens
GIFKNTIDYTFWITEKYRCTLRLPMFINMLCPLTEVTGLLELTLRSVDSHITRNVFVFSSEQTVQEQHTRSHEKCLGNQQGNRTIFIHIPSWTRDLFLQTDSSISPLSFVCC

SEQ ID NO: 773170 - protein, 98 aa, Homo sapiens
RLTSAGAGIRSSPRSEAGLGAGAPQVGRGSSEIVPRDLRMKDKFLKHLTGPLYFSPKCSKHFHRLYHNTRDCTIPAYYKRCARLLTRLAVSPVCMEDK

SEQ ID NO: 773171 - protein, 280 aa, Homo sapiens; identical to SEQ ID NO: 773168

SEQ ID NO: 773172 - protein, 95 aa, Homo sapiens
MMMTATQRARHPTQAHFKILLASSLLKFLYPKQGTQLVQISTGLQISRSKNGVFTSAPYLSLQEILGLAASDMSWNPLPEIAVFLDGLSTSSTTK

SEQ ID NO: 773173 - protein, 33 aa, Homo sapiens
GGTPWWCDPCPLDAYGPAGESRVNPDKQKHPLQ

SEQ ID NO: 773174 - protein, 159 aa, Homo sapiens
MAILADGELPPFHRRHWGPKGLENGLRSEQECGQGLAHLADPCSTVTAPQNWKLLCRQACSVSAPSVPGSPAPIRNPSASQGAGIIGMSRHAWLSSVIFTPDLVCLSPLPPHSSRVLRYPHLTWGQLWALVMLRMPRHSDHSLSYPRPFRIPSSRSLTR

SEQ ID NO: 773175 - protein, 340 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 773176 - protein, 31 aa, Homo sapiens
MRDRYDAFCFTSALAGPRCLSCPGRLTLFEP

SEQ ID NO: 773177 - protein, 340 aa, Homo sapiens; identical to SEQ ID NO: 773175

SEQ ID NO: 773178 - protein, 403 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGEALPLPPHSCVAAGPPRLGLPGLLPSISSAPLGTPAPSPRPRRPSSPSAPIRWPSPGSPPPPGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 773179 - protein, 112 aa, Homo sapiens
SRPSPPTLPSVGDPLWSPGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 773180 - protein, 141 aa, Homo sapiens
MRTQAPEGRGQKLFLKGAKGATVLNRGSSSRVLRCLELPGAWQTFIQNLFLKQDKKLLSTAPSVSVKRPASNRRCRADPPSCQAGSPSPHSAASFFGPSPSSTKPKETQVRPQPRPESGGGLGRLQGWGKGKGQLLQVPRD

SEQ ID NO: 773181 - protein, 403 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGEALPLPPHSCVAAGPPRLGLPGLLPSISSAPLGTPAPSPRPRRPSSPSLPSAGPPQDPRHPLGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 773182 - protein, 403 aa, Homo sapiens; identical to SEQ ID NO: 773181

SEQ ID NO: 773183 - protein, 293 aa, Homo sapiens
PRGTFHKGSATKPAGCQSSSKDRSAASTPSKALKFPVHPRKAVGSLAPGELALWHREWDEARTPKAKPGPSSQGSGSPRPGTKTGGGSQPQPASGQLQSEDSTTPDKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 773184 - protein, 293 aa, Homo sapiens; identical to SEQ ID NO: 773183

SEQ ID NO: 773185 - protein, 71 aa, Homo sapiens
AAWRGALLYHCCACSPEPHLFLLCSAAHLNAPKQVLGTHFSKQHDERMTSKSLVLYSSLHRLIHTDLIGLT

SEQ ID NO: 773186 - protein, 87 aa, Homo sapiens
AARSAGTPFPRKSPLHWALKDKQELVTQAEEERASQAGGAAYAKARRGPRSLGSLGKCEHFGEWRLERCGEWGLVAGNEAAAGWATW

SEQ ID NO: 773187 - protein, 76 aa, Homo sapiens
RGGTAGGARLPERRPGHDPRCSVLQARRRGPPSPTAAATTTSARAGLARLGRGSAVSPPRRKRPAEVPTWGLRCPA

SEQ ID NO: 773188 - protein, 87 aa, Homo sapiens; identical to SEQ ID NO: 773186

SEQ ID NO: 773189 - protein, 76 aa, Homo sapiens; identical to SEQ ID NO: 773187

SEQ ID NO: 773190 - protein, 167 aa, Homo sapiens
RGGTAGGARLPERRPGHDPRCSVLQARRRGPPSPTAAATTHRVGAVVGPFDSRRSGARGIPAKVLRSPPKPQKKGANKNGGGKKGPGAPWAKEEVARDGGFKMSCLESSSSSHDEAPVLNDKHLDVPDIIITPPTPTGMMLPRDLGSTVWLDETGSCPDDGEIDPEA

SEQ ID NO: 773191 - protein, 173 aa, Homo sapiens
MDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 773192 - protein, 173 aa, Homo sapiens; identical to SEQ ID NO: 773191

SEQ ID NO: 773193 - protein, 173 aa, Homo sapiens; identical to SEQ ID NO: 773191

SEQ ID NO: 773194 - protein, 136 aa, Homo sapiens
MPVCPGDSHRPPKALPHLVCGRRGRQVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 773195 - protein, 173 aa, Homo sapiens; identical to SEQ ID NO: 773191

SEQ ID NO: 773196 - protein, 135 aa, Homo sapiens
MDVTIQHPWFKRTLGPFYPSRLFDQFFGEGLFEYDLLPFLSSTISPYYRQSLFRTVLDSGISEVRRGPWCWPLLAAQRVVASVGGERWTLVLLRQAGGLVPLHPLAEAGREPVSPLQPRGRASPGTGERVDKGAA

SEQ ID NO: 773197 - protein, 135 aa, Homo sapiens; identical to SEQ ID NO: 773196

SEQ ID NO: 773198 - protein, 1251 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSHRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 773199 - protein, 766 aa, Homo sapiens
MATPCQNMELNRLVQDQIPGQVASASALQNLVEHLPNVPSYRIPITRIPVLTSRRTSLSNSSFAKETRSSIRQLVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARPRARKTSRERKAPPPQTSTRTQRRPPPTHPRPGRPPSPRGLHRALHRLPPLGGRRERRRGRPSPKSTR

SEQ ID NO: 773200 - protein, 368 aa, Homo sapiens
VHALCSFCRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARPRARKTSRERKAPPPQTSTRTQRRPPPTHPRPGRPPSPRGLHRALHRLPPLGGRRERRRGRPSPKSTR

SEQ ID NO: 773201 - protein, 118 aa, Homo sapiens
ADIETSNWPRNSSFGAASEKQFQTVIGKNFWVGTQVAVAVEEGCGVHSRRAPWVLHTELAVACIMVPGSSQIWIQGLQLGPFSLHPLPGPQGWFRWSPMSSHSPSQESPRASSRHKAR

SEQ ID NO: 773202 - protein, 1245 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSHRVLTWLMKGVEKVIPQPVHSITEDPAQILGHGSTGDTGCTDEPNEALEAQDTRPGLRLLLWLEQNLERVLPQPPKSSEVWRDEPAVATAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 773203 - protein, 299 aa, Homo sapiens [sequence omitted]

SEQ ID NO: 773204 - protein, 165 aa, Homo sapiens
MATPCQNMELNRLVQDQIPGQVASASALQNLVEHLPNVPSYRIPITRIPVLTSRRTSLSNSSFAKETRSSIRQLVPATKQHPEVQVEDTDADSCPLMAEENPPSTVLPPPSPAKSDTLIVPSSASGTHRKKLPSEDDEAEELKALSPAESPVVAWSDPTTPKDTE

SEQ ID NO: 773205 - protein, 515 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSHRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGGRSCPLRMMRLKSSRRCHQQSPQWLPGLTPPPRRTLSETPLGSQKIERLRGGWGMWGG

SEQ ID NO: 773206 - protein, 353 aa, Homo sapiens
HLLHKAAGERERESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 773207 - protein, 218 aa, Homo sapiens
AGTRRNLGIEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 773208 - protein, 140 aa, Homo sapiens
SVARRAQWYVVPSNETASTMSCTVGNRWHHSMPEQWQVGQAPNCLHQTQTFTSDAATPPPPPTPPPASPPQIPQGAQKTQETPNGGLGEGRREFLLKNQKKESTTPFPCLLWSLRLGRQNPERNKRVQKSLNPKPHPPHT

SEQ ID NO: 773209 - protein, 1321 aa, Homo sapiens
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 773210 - protein, 1321 aa, Homo sapiens; identical to SEQ ID NO: 773209

SEQ ID NO: 773211 - protein, 1275 aa, Homo sapiens
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKRK

SEQ ID NO: 773212 - protein, 1321 aa, Homo sapiens; identical to SEQ ID NO: 773209

SEQ ID NO: 773213 - protein, 1260 aa, Homo sapiens
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTARRSHRMRRHHHHHQHHHQHHHHKSRKERRKHKKHPTEDWEKDEGNFC

SEQ ID NO: 773214 - protein, 203 aa, Homo sapiens
MRREKSSSATRPHTLHQLCFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 773215 - protein, 1321 aa, Homo sapiens; identical to SEQ ID NO: 773209

SEQ ID NO: 773216 - protein, 1321 aa, Homo sapiens; identical to SEQ ID NO: 773209

SEQ ID NO: 773217 - protein, 261 aa, Homo sapiens
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773218 - protein, 239 aa, Homo sapiens
MARQLLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773219 - protein, 255 aa, Homo sapiens
MDEALETQLKTSRGRFSATESLPTLELLSQVDMDCRVHMRPIGLTWVLQLTLAWILLEACGGSRPLQARSQQHHGLAADLGKGKLHLAEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773220 - protein, 254 aa, Homo sapiens
MDCRVHMRPIGLTWVLQLTLAWILLEACGGSRPLQARSQQHHGLAADLGKGKLHLAGDPQASVPKPYLNIQDPSSQGSPLPGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773221 - protein, 229 aa, Homo sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773222 - protein, 334 aa, Homo sapiens
MDEALGEGLNPLFPRFRLGMEPESGPILGFIYNSRLPSLGLSPKEAQKGQTPGRALGHRYHHLPLWDVWDRTSVLTLNFRTNPSETQLKTSRGRFSATESLPTLELLSQVDMDCRVHMRPIGLTWVLQLTLAWILLEACGGSRPLQARSQQHHGLAADLGKGKLHLAEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 773223 - protein, 86 aa, Homo sapiens
VSAGEDSISTLGLILGVGLLLLLVSILGYSLAKWYQRGYCWEGPNFVFNLYQIRNLKDLEMGPPFTISGHISSTDGGYMKFSNGLV

SEQ ID NO: 773224 - protein, 87 aa, Homo sapiens
KGKLKPMQVALSEDDLTVLMKILLENLGEASSQPSPTQSVQETVRVRKVDVSSVPDHLKEQEDWTDSKLSMNQIVSLQFDFHFESLS

SEQ ID NO: 773225 - protein, 138 aa, Homo sapiens
TGTSCDAPAAAAAWSERASERWWVPCDGGVGDRSPRSVAGAWTPPGTLPAPSLPLPVFVPALLRGHLGPSPPLGGGCAVLATAASAPRPGRLCQCPTRVQRIGAPWPTAGGKTRDLGPSEPQGPLSWSLGLFLMPQHL

SEQ ID NO: 773226 - protein, 232 aa, Homo sapiens
VKRCVQQLGLALDFMHGRQLVHRDIKPENVLLFDRECRRVKLADFGMTRRVGCRVKRVSGTIPYTAPEVCQAGRADGLAVDTGVDVWAFGVLIFCVLTGNFPWEAASGADAFFEEFVRWQRGRLPGLPSQWRRFTEPALRMFQRLLALEPERRGPAKEVFRFLKHELTSELRRRPSHRARKPPGDRPPAAGPLRLEAPGPLKRTVLTERGSGSRPAPPADGSAPKPEPVPAP

SEQ ID NO: 773227 - protein, 69 aa, Homo sapiens
PRASASSNAQGPMACLICQHMIPQNIASDQVSDLATEVAQHGIMKSVAILLGPTTIQKAAGLIKPWNCL

SEQ ID NO: 773228 - protein, 65 aa, Homo sapiens
CSEIPGDMKGPLEDCDHELKVRLVGVIVSFSPAILSCIVVEAEEVNLTRGPNFLENTQLKRSNLP

SEQ ID NO: 773229 - protein, 98 aa, Homo sapiens
LGVPRVTTSSPRREGLCFPGGALSQPQEPLVTALTLFPHLGSALGGLHSCHAPRWPWSSTEACFGDTRGPDLSELGSCHLRAVLSESGGTAAFTHGRV

SEQ ID NO: 773230 - protein, 111 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKSV

SEQ ID NO: 773231 - protein, 111 aa, Homo sapiens; identical to SEQ ID NO: 773230

SEQ ID NO: 773232 - protein, 75 aa, Homo sapiens
VWRSEDPPLLMRWRRKYWQFLHQSHEEREHAEKLMKLQNQRGGRIFLQDIKKPDCDDWESGLNAMECALHLEKSV

SEQ ID NO: 773233 - protein, 144 aa, Homo sapiens
MRPLQRLICFCRYLRWFTFRFDLPGLSSASLMLLDAESMKLSRSRVASRTSPPSAPDSSAPAGAPVSSSSKQQPLSRAPKAPPSPSGEPPKPKGTKGCVLRSAACTAIAAAPGLSAALPVRPRQLLPAAQTQLPPRRGARGAAY

SEQ ID NO: 773234 - protein, 144 aa, Homo sapiens; identical to SEQ ID NO: 773233

SEQ ID NO: 773235 - protein, 165 aa, Homo sapiens
MGRRRRGQGAVWKEGGERGQMAPARPPRRENPQRRGTGGSRARSRSSRRGGQSGGSFWSGSSPGRSRARGTVGFPPLPAAAQRGRAPAPGVPAVRRLRRGTRREARRQARLPPPCRRRNRRGSRAVRSAARAPPPAPARRPDPAPAPARRARRSLLVPGLARCAA

SEQ ID NO: 773236 - protein, 43 aa, Homo sapiens
MWQIPIPLTSLYYVAFPGGYLMGSRDVHTTSPQLPSSDLTCTA

SEQ ID NO: 773237 - protein, 737 aa, Homo sapiens
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFQGIWWT

SEQ ID NO: 773238 - protein, 529 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTIGATTTQFRVLTTTRRAVTSQFPTSLPTEDDTKIALHLKDNGASTDDSAAEKKGGTLHAGLIVGILILVLIVATAILVTVYMYHHPTSAASIFFIERRPSRWPAMKFRRGSGHPAYAEVEPVGEKEGFIVSEQC

SEQ ID NO: 773239 - protein, 480 aa, Homo sapiens [sequence omitted]

SEQ ID NO: 773240 - protein, 375 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQSQKRRCVRIQNQWKLLLEPPQP

SEQ ID NO: 773241 - protein, 238 aa, Homo sapiens
MEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQSQKRRCVRIQNQWKLLLEPPQP

SEQ ID NO: 773242 - protein, 498 aa, Homo sapiens [sequence omitted]

SEQ ID NO: 773243 - protein, 138 aa, Homo sapiens
MEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 773244 - protein, 263 aa, Homo sapiens
SFLGRSTDRAPLSCQGGDAALAGSEGILKGIMSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNIPSQANVHCSSVPTGDQSLSYVHGIPRRKLRDWSLEQMVRGSSDQPEDIGQSPSGTTNEDAFLLALVRRELKSRPLSSNLLEKLQKELKILDPISSGFLLQSQLSRLFLKHEVPLQLP

SEQ ID NO: 773245 - protein, 348 aa, Homo sapiens
SFLGRSTDRAPLSCQGGDAALAGSEGILKGIMSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNVRAICGKHGLYLTLSLLETLLNHQDLGYQNEIKWQNFVEMLTRASSDLLSDLPTGKNEKEAPAPPMEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 773246 - protein, 164 aa, Homo sapiens [sequence omitted]

SEQ ID NO: 773247 - protein, 207 aa, Homo sapiens
KHLQINWTGLTNLLDAPGINDVSDSLLEDLIATHLVLPNRVTVPVKKGLDLTNLRFPLPCGVIRVHFAEAEQLARRDTFWGSEAVRSLRQGEHSLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESA

SEQ ID NO: 773248 - protein, 118 aa, Homo sapiens
LCLGCWVCLVVCLSVCALDAGSVWWSVCVLDAWSAWWSVCLCLGCWICLVVCLSVSQMLGLLGGLSVCVLDAGSAWWSVCLCLGYWICLVVCLSVCVLDAGCAWWSVCLSVCALDAGS

SEQ ID NO: 773249 - protein, 71 aa, Homo sapiens
FNSPTSSPLKVTAIPRKQSSLIPLPSWQTLCHALRTTKLRDETDRRKGGWDYVYCLYSEKCSNKKREDPFL

SEQ ID NO: 773250 - protein, 37 aa, Homo sapiens
MTGLLGLEFHGAGPQCMGGVQPLVLNQPRDPSLLGCL

SEQ ID NO: 773251 - protein, 433 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773252 - protein, 433 aa, Homo sapiens; identical to SEQ ID NO: 773251

SEQ ID NO: 773253 - protein, 433 aa, Homo sapiens; identical to SEQ ID NO: 773251

SEQ ID NO: 773254 - protein, 433 aa, Homo sapiens; identical to SEQ ID NO: 773251

SEQ ID NO: 773255 - protein, 457 aa, Homo sapiens
GRENTRSPVTRPRHNRAEAFGAAKMPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773256 - protein, 278 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGLEWFVTLGMAEKKAAYFLRMGYGGA

SEQ ID NO: 773257 - protein, 459 aa, Homo sapiens
FKELGGFWRLLTRCPCNYATRCPIRASNDRRRLTEEGRRSAIRALDEWEILVLCLINLCVNAGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773258 - protein, 141 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVG

SEQ ID NO: 773259 - protein, 415 aa, Homo sapiens
MPDYLGADQRKTKEDEKDDKPIRALDEGDIALLKTYGQSTYSRQIKQVEDDIQQLLKTLWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773260 - protein, 337 aa, Homo sapiens
MCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773261 - protein, 351 aa, Homo sapiens
GRVGPDAWEPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773262 - protein, 296 aa, Homo sapiens
MRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773263 - protein, 250 aa, Homo sapiens
DDLVMYYVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773264 - protein, 278 aa, Homo sapiens; identical to SEQ ID NO: 773256

SEQ ID NO: 773265 - protein, 433 aa, Homo sapiens; identical to SEQ ID NO: 773251

SEQ ID NO: 773266 - protein, 433 aa, Homo sapiens; identical to SEQ ID NO: 773251

SEQ ID NO: 773267 - protein, 432 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYLYY

SEQ ID NO: 773268 - protein, 444 aa, Homo sapiens
MCSRCVINSGSRLSGETKEDEKDEKAIRALDEGDIGPLFDKLMCHMLGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773269 - protein, 141 aa, Homo sapiens; identical to SEQ ID NO: 773258

SEQ ID NO: 773270 - protein, 296 aa, Homo sapiens; identical to SEQ ID NO: 773262

SEQ ID NO: 773271 - protein, 277 aa, Homo sapiens
MLYISVPLLVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773272 - protein, 178 aa, Homo sapiens
MVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 773273 - protein, 36 aa, Homo sapiens
MGLGNCSISKQCAVNWLPSVPLTVQRHFCPPNAYGP

SEQ ID NO: 773274 - protein, 70 aa, Homo sapiens
IFRSMCHHLDTLGNTPCWAGVSSQGLRQPSSHDFAGLSPHNCSHRIELYTGAYSFPGPVLHAASGCSSSP

SEQ ID NO: 773275 - protein, 95 aa, Homo sapiens
PQVLHPVLTPPPAGPHAQLPVEGPGSLSHSVSAAAVNAHRETGTLTPASTLPQLTSLHPSTLPLHHHCRCWHMQARMDLLPPSYKMVWLAPSIRV

SEQ ID NO: 773276 - protein, 192 aa, Homo sapiens
MLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSTCFFPCYRLYYFFICALEAF

SEQ ID NO: 773277 - protein, 78 aa, Homo sapiens
LAYRACGRSCCFSTHPPFPLLVSEGEPASRPEVEHSSSLLSPAGSPNSALQWLPGHPRNPAEPAPPGPGPLCCSVLHP

SEQ ID NO: 773278 - protein, 60 aa, Homo sapiens
MTVPWGNYRDFLDTQTSGPQRGFGSRSLSLKEPIQNFSVTLSDDIHLAVGSPSTLNEDMV

SEQ ID NO: 773279 - protein, 248 aa, Homo sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 773280 - protein, 230 aa, Homo sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFDAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 773281 - protein, 248 aa, Homo sapiens; identical to SEQ ID NO: 773279

SEQ ID NO: 773282 - protein, 248 aa, Homo sapiens; identical to SEQ ID NO: 773279

SEQ ID NO: 773283 - protein, 108 aa, Homo sapiens
GVPGHRAKPPWSPSGSRLCAAPECDALGPPLSQAESCTHTLRLHFLLQRISLMLTSSMETWGTPPSASSMSSLGSSLALTHTGKDFSFSWEGWLAEGWWILELDQQLA

SEQ ID NO: 773284 - protein, 122 aa, Homo sapiens
SSIANMVNVPKTRRAFCKKCGKHQPYKVPQYKGKDSSYAQGKMRCDQKQSGYGGQTKLIFWKKAETTQMIVLRLECREPNCRSKGMLAIQKCKLFFFFKTGPHSVSQAGVQSWLTAALTSLA

SEQ ID NO: 773285 - protein, 293 aa, Homo sapiens
MPTSSSFKHRIKEQEDYIRDWTAHREEIARISQDLALIAREINDVAGEIDSVTSSGTAPSTTLVDRVFDESLNFQKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRVNPDGEEEDVTVHK

SEQ ID NO: 773286 - protein, 412 aa, Homo sapiens
IDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFQKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRVNPDGEEEDVTVHK

SEQ ID NO: 773287 - protein, 402 aa, Homo sapiens
IDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFQKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRVNPDGEEEDVTVHK

SEQ ID NO: 773288 - protein, 129 aa, Homo sapiens
RSLGEKIMEQVSGKLDSIPYLPPTSCGTPGKVILPLSLSFLIEKSRMTRCSFQALKSRDRVSSRGQVGFKLLTSSDPPISASQSARIIDVSPRAQLILHFQLSVSLDCLLPTLYPLTDSVQSPTPNSKI

SEQ ID NO: 773289 - protein, 890 aa, Homo sapiens
PADPSVTPLCRPQNQPRQLAPTLPPIGQAARGRGPESWSLCWARTPSLRWQQSRAVGAAAIGRGVARAGLQELPGGSGAKKWEEGKKAGGIWGQARGQPALKYAEGLLPAPGIRGERASQKFGCSCPGGVDGCAPRAARGLSGRHFPSGPAFVSGISSSCCVWPPTAAAAAETLARTKEEETAGAAAALGPGGTMGNGMCSRKQKRIFQTLLLLTVVFGFLYGAMLYYELQTQLRKAEAVALKYQQHQESLSAQLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLQLQQEKEQELSKLKETVYNLREENRQLRKAHQDIHTQLQDVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEDLTEEKKRELEHNAEETYGENDENTDDKNNDGEEQEVRDDNRPKGREEHYEEEEEEEEDGAAVAEKSHRRAEM

SEQ ID NO: 773290 - protein, 577 aa, Homo sapiens [sequence omitted]

SEQ ID NO: 773291 - protein, 362 aa, Homo sapiens
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 773292 - protein, 69 aa, Homo sapiens
AEDRTLSYGVSWIHTEPIHGQMHHHYFYTTKKGETLPIKTMTLKSKAINDKTILMSVQLSVRNVHLGIH

SEQ ID NO: 773293 - protein, 890 aa, Homo sapiens
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 773294 - protein, 890 aa, Homo sapiens; identical to SEQ ID NO: 773293

SEQ ID NO: 773295 - protein, 844 aa, Homo sapiens
AAEMSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRKWCPDVLPRTRRIRHQGH

SEQ ID NO: 773296 - protein, 324 aa, Homo sapiens
AAEMSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVGPANVSLPISQGRLTTRDILPPFFNGGVFFGPFFKGGKG

SEQ ID NO: 773297 - protein, 505 aa, Homo sapiens
LPAPGLLGCSPTTAQPCHTPRPRPPQLGMGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 773298 - protein, 130 aa, Homo sapiens
AAAAADPPRCWPRRWAWAAACPGVPGDCGAATAPSPTRPSAAARPAAPPPRSADLHARTPGHPDKLRRGADRPTDRGRRLEGLRIRRKRQLGARGPVEEAELLPTPQNLHSMDLDLWIRLSPWALPSGRR

SEQ ID NO: 773299 - protein, 130 aa, Homo sapiens; identical to SEQ ID NO: 773298

SEQ ID NO: 773300 - protein, 104 aa, Homo sapiens
AAAAADPPRCWPRRWAWAAACPGVPGDCGAATAPSPTRPSAAARPAAPPPRSADLHARTPGHPDKLRRGADRPTDRGRRLEGLRIRRKRQLGARGPVEEAEVRS

SEQ ID NO: 773301 - protein, 103 aa, Homo sapiens
AAAADPPRCWPRRWAWAAACPGVPGDCGAATAPSPTRPSAAARPAAPPPRSADLHARTPGHPDKLRRGADRPTDRGRRLEGLRIRRKRQLGARGPVEEAEVRS

SEQ ID NO: 773302 - protein, 232 aa, Homo sapiens
MTKKKVSQKKQRGRPSSQPCRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVETKPSVYFIKFDDDFHIYVYDLVKKS

SEQ ID NO: 773303 - protein, 104 aa, Homo sapiens
LTGISLFFLFSISPPPLPPTPISPPNYCQTDCPLHSQTISCYSLPPAEFIHLQIPSTSTIPNCSQFSKHSLLFSTLWLCTLLSLPIMLSLPPHPPGEELILKTW

SEQ ID NO: 773304 - protein, 140 aa, Homo sapiens
APGPHIGILPSLASTFVTIRSFAHIDTILLRMLSFVALCILGKSRIKSLLGVVGCLVVVRSSALTLSPGPPIQTFEISIPSNSDGQKCIESLLCSSRVVNTRDTAGNQQGCLSSPSLYSHGGKIINYISVCLYRERGKRE

SEQ ID NO: 773305 - protein, 67 aa, Homo sapiens
LLEEPRLGFFESLTHLIGNLEKYSFKSYIRTIQYVVENEVKIGSMGFCFLLFAGIIESYITELKEKY

SEQ ID NO: 773306 - protein, 88 aa, Homo sapiens [sequence omitted]

SEQ ID NO: 773307 - protein, 137 aa, Homo sapiens [sequence omitted]

SEQ ID NO: 773308 - protein, 275 aa, Homo sapiens
WEVGAAAVSAFAMRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 773309 - protein, 275 aa, Homo sapiens; identical to SEQ ID NO: 773308

SEQ ID NO: 773310 - protein, 152 aa, Homo sapiens [sequence omitted]

SEQ ID NO: 773311 - protein, 107 aa, Homo sapiens
LVLTRELWDVGLKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 773312 - protein, 275 aa, Homo sapiens; identical to SEQ ID NO: 773308

SEQ ID NO: 773313 - protein, 275 aa, Homo sapiens; identical to SEQ ID NO: 773308

SEQ ID NO: 773314 - protein, 275 aa, Homo sapiens; identical to SEQ ID NO: 773308

SEQ ID NO: 773315 - protein, 275 aa, Homo sapiens; identical to SEQ ID NO: 773308

SEQ ID NO: 773316 - protein, 275 aa, Homo sapiens; identical to SEQ ID NO: 773308

SEQ ID NO: 773317 - protein, 171 aa, Homo sapiens
MRQRRVVSDVEQPAAAQSRALCPAEPSPLWGSSGGDHGPLLTHWPRGGCRRQDSRMCDIRSPGAGCPSGTTRCLLPPQWGSHPGLLGPPQPAPARPADPDSSQTCLTHQCSRGWRHQPGAGLGPVLPRRLTLPSICVDAQNRLPVPACKPQPQTSYGERTTRRISSFPGLG

SEQ ID NO: 773318 - protein, 275 aa, Homo sapiens
WEVGAAAVSAFAMRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGAESNLYATDTP

SEQ ID NO: 773319 - protein, 115 aa, Homo sapiens
WEVGAAAVSAFAMRPGAPGPLWPLPWGALAWAVGFVSSMGSGNPAPGGVCWLQQGQEATCSLVLQTDVTRAECCASGNIDTAWSNLTHPGNKINLPDDILEGLRKGGLGAGWWVG

SEQ ID NO: 773320 - protein, 275 aa, Homo sapiens; identical to SEQ ID NO: 773308

SEQ ID NO: 773321 - protein, 275 aa, Homo sapiens; identical to SEQ ID NO: 773308

SEQ ID NO: 773322 - protein, 248 aa, Homo sapiens
WEVGAAAVSAFAMRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSSPQAVPYLWCPEKCP

SEQ ID NO: 773323 - protein, 109 aa, Homo sapiens
VGSGPPLASEWEGSRLGVWLSFLGKYKLELGPRYLWEKLVVPLPIRVTHEVAVPGFLRPGRLSLASSQPQSHRFRQEGPYGSPALTHIPTLHPHPAPVMAPPEHEHSPS

SEQ ID NO: 773324 - protein, 35 aa, Homo sapiens
QTSSSPFCFTATVAYLVSQPQHHPSNPFLRHIRVP

SEQ ID NO: 773325 - protein, 164 aa, Homo sapiens
QSTKAIQYSLMYASFLQNPNGAALRGIYTNLIGIKKRHLFHSENAVTSSACAARKARLSKGLLLCRKKAQLQRRGDTLEAGSACLATPGSALLFPVPWAGSFRPSLIDWVNINPGTAGVCAAPIIRLLWASLCPCVPPLRNVSLRTVQKCEQVKRATITSLMIC

SEQ ID NO: 773326 - protein, 579 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALSVSLERFPSQNINTARSRLSTTWHSAGILLRGSFLPGASRAFASVCYGGAAVDNRIREC

SEQ ID NO: 773327 - protein, 133 aa, Homo sapiens
MRRMLSEYFSGLCTRTNTSQRVREPLTSPAACHTKAPGRSEAQLLFIIFLWFLQWSLALSPRLECSGTISAHCDLRLLGSSDSPASASQVAGITGVHHHAWLIFVFLVETGFHHVGQADLEPLPQVIHPSWPP

SEQ ID NO: 773328 - protein, 505 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEVKAVPAALSVRPSSECPRTGCWWVY

SEQ ID NO: 773329 - protein, 505 aa, Homo sapiens; identical to SEQ ID NO: 773328

SEQ ID NO: 773330 - protein, 456 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEED

SEQ ID NO: 773331 - protein, 224 aa, Homo sapiens [sequence omitted]

SEQ ID NO: 773332 - protein, 925 aa, Homo sapiens
MVSLSLPAVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKVRLGQLLKQQEKMIRAMELAVARRETVTTQAEGQRKMDRKALTRTDFHHKQLELRRKIRDVRKATDECTKTVLELEETQRNVSSSLLEKQEKLSVIQADFDTLEADLTRLGALKRQNLSEIVALQTRLKHLQAVKEGRYVFLFRSKQSLVLERQRLDKRLALIATILDRVRDEYPQFQEALHKVSQMIANKLESPGPS

SEQ ID NO: 773333 - protein, 92 aa, Homo sapiens
MGVQHRFRLSHGSDIESSDLEEFVSQEPGATHLLRSPCPGDEHLHRPFCARDATRLSSVTCFLSGCEPKMAGRVPRTAVPCFLLGLCMGDAG

SEQ ID NO: 773334 - protein, 559 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRYCRATGSEDVREPQGSVAGPPHTPSLWVHRISGTEGAP

SEQ ID NO: 773335 - protein, 902 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKVRPCPRSPGAQDDGGRGPLRGRPSRCRTS

SEQ ID NO: 773336 - protein, 106 aa, Homo sapiens
TIFLHLLLREASRFYKYQLLAQEDLGFVPPPSPLLLPPPPRLRLCAVLILVGVGLEATPSPGVSSAIFFVPGFLLLVPGVYHVIFIYCAVKGHRGFQFFYLPYFEK

SEQ ID NO: 773337 - protein, 186 aa, Homo sapiens
MSAARPQFSIDDAFELSLEDGGPGPESSGVARFGPLHFERRARFEVADEDKQSRLRYQNLENDEDGAQASPEPDGGVGTSSQWSFSTISSSTQRSYNTCCSWTQHPLIQKNRRVVLASFLLLLLGLVLILVGVGLEATPSPGVSSAIFFVPGFLLLVPGVYHVIFIYCAVKGHRGFQFFYLPYFEK

SEQ ID NO: 773338 - protein, 183 aa, Homo sapiens
MSAARPQFSIDDAFELSLEDGGPGPESSGVARFGPLHFERRARFEVADEDKQSRLRYQNLENDEDGAQASPEPDGGVGTSSQWSFSTISSSTQRSYNTCCSWTQHPLIQKNRRVVLASFLLLLLGLGPAQCLALETELGELPGEGLCLGHLQLRWWVSRAGGGSPRPHHCSCPHPRGSVCVQC

SEQ ID NO: 773339 - protein, 180 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGVSSAIFFVPGFLLLVPGVYHVIFIYCAVKGHRGFQFFYLPYFEK

SEQ ID NO: 773340 - protein, 192 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGPAQCLALETELGELPGEGLCLGHLQLRWWVSRAGGGSPRPHHCSCPHPRGSVCVQC

SEQ ID NO: 773341 - protein, 192 aa, Homo sapiens; identical to SEQ ID NO: 773340

SEQ ID NO: 773342 - protein, 195 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLVLILVGVGLEATPSPGVSSAIFFVPGFLLLVPGVYHVIFIYCAVKGHRGFQFFYLPYFEK

SEQ ID NO: 773343 - protein, 192 aa, Homo sapiens; identical to SEQ ID NO: 773340

SEQ ID NO: 773344 - protein, 139 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGEWP

SEQ ID NO: 773345 - protein, 139 aa, Homo sapiens; identical to SEQ ID NO: 773344

SEQ ID NO: 773346 - protein, 221 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLVLILVGVGLEATPSPGVSSAIFFVPGFLLLVPGGPPGLPVLLPALLREVIAAQRGPLAPMGAPLLPCSVPLISREEALQDPRNPSP

SEQ ID NO: 773347 - protein, 130 aa, Homo sapiens
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLP

SEQ ID NO: 773348 - protein, 130 aa, Homo sapiens
PDGPLTGNTLGCCITLTSGSQPALKFKNQVLKSISAFSYLTFELLNLSKRQAEERGIGKAKAFWGRKIGPLYPAFLRVPMAEHSMSPPPRALPDYPQGLVLPRLQSFMDALPIPLLGSAVSSVPQLRICL

SEQ ID NO: 773349 - protein, 457 aa, Homo sapiens
TVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSHTNSSAKHSEASVLTVADLADLFTKETEELE

SEQ ID NO: 773350 - protein, 481 aa, Homo sapiens
TVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERRFFEEQALFCFHDITPFSHPWSLTTAILQLRDLVICELFFIYFKNFLICFLSSFSI

SEQ ID NO: 773351 - protein, 426 aa, Homo sapiens
TVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERR

SEQ ID NO: 773352 - protein, 138 aa, Homo sapiens
KKQAVPVRIPGSASPGGGWKGWRTHLNMWNPNAAPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 773353 - protein, 148 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 773354 - protein, 148 aa, Homo sapiens; identical to SEQ ID NO: 773353

SEQ ID NO: 773355 - protein, 148 aa, Homo sapiens; identical to SEQ ID NO: 773353

SEQ ID NO: 773356 - protein, 148 aa, Homo sapiens; identical to SEQ ID NO: 773353

SEQ ID NO: 773357 - protein, 148 aa, Homo sapiens; identical to SEQ ID NO: 773353

SEQ ID NO: 773358 - protein, 148 aa, Homo sapiens; identical to SEQ ID NO: 773353

SEQ ID NO: 773359 - protein, 135 aa, Homo sapiens
MPGSQGQIHIPPILGALEVPILPTHHLLIHPFPQAPVLLPQELPMAIQLSPQVGPLILCHSRPYPPPYPPPAPGIPPVNPLAPGMVGPAVIVDKKMQKKMKKAHKKMHKHQKHHKYHKHGKHSSSSSSSSSSDSD

SEQ ID NO: 773360 - protein, 148 aa, Homo sapiens; identical to SEQ ID NO: 773353

SEQ ID NO: 773361 - protein, 148 aa, Homo sapiens; identical to SEQ ID NO: 773353

SEQ ID NO: 773362 - protein, 148 aa, Homo sapiens; identical to SEQ ID NO: 773353

SEQ ID NO: 773363 - protein, 148 aa, Homo sapiens; identical to SEQ ID NO: 773353

SEQ ID NO: 773364 - protein, 148 aa, Homo sapiens; identical to SEQ ID NO: 773353

SEQ ID NO: 773365 - protein, 148 aa, Homo sapiens; identical to SEQ ID NO: 773353

SEQ ID NO: 773366 - protein, 148 aa, Homo sapiens; identical to SEQ ID NO: 773353

SEQ ID NO: 773367 - protein, 148 aa, Homo sapiens; identical to SEQ ID NO: 773353

SEQ ID NO: 773368 - protein, 148 aa, Homo sapiens; identical to SEQ ID NO: 773353

SEQ ID NO: 773369 - protein, 130 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHPSSSDSD

SEQ ID NO: 773370 - protein, 69 aa, Homo sapiens
EWLALLYGIPPVNPLAPGMVGPAVIVDKKMQKKMKKAHKKMHKHQKHHKYHKHGKHSSSSSSSSSSDSD

SEQ ID NO: 773371 - protein, 111 aa, Homo sapiens
MWNPNAAPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 773372 - protein, 40 aa, Homo sapiens
TREVGILMVDFCRAQLSLVIWVQSVSGPTCPDAVPTLFSR

SEQ ID NO: 773373 - protein, 248 aa, Homo sapiens
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 773374 - protein, 248 aa, Homo sapiens; identical to SEQ ID NO: 773373

SEQ ID NO: 773375 - protein, 186 aa, Homo sapiens
KRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 773376 - protein, 267 aa, Homo sapiens
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 773377 - protein, 223 aa, Homo sapiens
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSWWCYQGEEIPALTRCVEHLQMNE

SEQ ID NO: 773378 - protein, 258 aa, Homo sapiens
MGLLRGGLPCARAMARLGAVRSHYCALLLAAALAVCAFYYLGSGRETFSSATKRLKEALRRGSRRALAAALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKGSGEILAKESNSSLVTRKNREGYKEARPVGASCVLNSNCER

SEQ ID NO: 773379 - protein, 247 aa, Homo sapiens
MVRCVPSAVIVCFLRPPQPGRTVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773380 - protein, 393 aa, Homo sapiens
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773381 - protein, 120 aa, Homo sapiens
AGTVRSFRIEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773382 - protein, 133 aa, Homo sapiens
MRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773383 - protein, 155 aa, Homo sapiens [sequence omitted]

SEQ ID NO: 773384 - protein, 393 aa, Homo sapiens; identical to SEQ ID NO: 773380

SEQ ID NO: 773385 - protein, 393 aa, Homo sapiens; identical to SEQ ID NO: 773380

SEQ ID NO: 773386 - protein, 139 aa, Homo sapiens
MEVACLLRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773387 - protein, 188 aa, Homo sapiens
MNGMSVLMKETLKSSVTPSPYEETGEKAAICELGSESSPDTESVGTLVLDFPASRTRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 773388 - protein, 393 aa, Homo sapiens; identical to SEQ ID NO: 773380

SEQ ID NO: 773389 - protein, 124 aa, Homo sapiens
MFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKGEPGLPGAIA

SEQ ID NO: 773390 - protein, 108 aa, Homo sapiens
CSDVPRARKTVHVNHPHTHYEGTRPRSESCRMGNRPLRTPELGQVRVPLCTNRMVCSHRGHQWGLWSWGSLLQLQDPQPGHQNLLVYLCRLRLIYVYDMNLRSLHGAP

SEQ ID NO: 773391 - protein, 361 aa, Homo sapiens
ARGASSVAGWVGAFRAPFIEAAVAGLGAGSGKRRRGWKMPVHSRGDKKETNHHDEMEVDYAENEGSSSEDEDTESSSVSEDGDSSEMDDEDCERRRMECLDEMSNLEKQFTDLKDQLYKERLSQVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTSAVITTINHDEVWFKRPDGSKSKLYISQLQKGKYSIKHS

SEQ ID NO: 773392 - protein, 361 aa, Homo sapiens; identical to SEQ ID NO: 773391

SEQ ID NO: 773393 - protein, 84 aa, Homo sapiens
LLQKKPSDGQSRVGLAVPQSSETLDSFYLGVIYWSCMAFGTPALASAAESAPLRSFLGSHTLNGSYLNLTSHSKLQNWLGNYMT

SEQ ID NO: 773394 - protein, 103 aa, Homo sapiens
GKMPWMWVGTVQSAGENPKEKGRGKVIIPLSLLELGHTSALGHQNSKLSGLWTPGLTPEPSPSPHHPTGFPDIEPGTESYIWASLGLQLAHGLLWDFAGFIIM

SEQ ID NO: 773395 - protein, 798 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 773396 - protein, 744 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 773397 - protein, 798 aa, Homo sapiens; identical to SEQ ID NO: 773395

SEQ ID NO: 773398 - protein, 380 aa, Homo sapiens
AEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMH

SEQ ID NO: 773399 - protein, 354 aa, Homo sapiens
AEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQR

SEQ ID NO: 773400 - protein, 453 aa, Homo sapiens
AEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 773401 - protein, 453 aa, Homo sapiens; identical to SEQ ID NO: 773400

SEQ ID NO: 773402 - protein, 125 aa, Homo sapiens
IYVSLAHWMQGEQALLAPSGQAVKQTSPSHTHWAAAVWPSPERNRTKYWAQAADHHRCHDVPLDVPPASTPHCAPQPPQGLCTHHPNGLSTSAQDQLLPPGHLLRGLPSLHPFTLPLYCPSTCHL

SEQ ID NO: 773403 - protein, 69 aa, Homo sapiens
MWDSPPIPESLAPGSHGLVWSLERSWLGRGQPENHVGVGCRRRQDMVVVVLGMKPCASRSSESEAGPGP

SEQ ID NO: 773404 - protein, 169 aa, Homo sapiens
RPLLSRGASPAFGCCVRLALPVELLLGWRKWTQPGGRRCWPQAHACKATRPCVTMPKPVNLGEETPWVGTSECLSSENGGSKKDRAPAAPEMCIFCDSVSREGLCSICLNISGTQPSSRHRKALVHRGVKGRALLPAPAHRGRCLHFRSLKPSVLSVWIKEWEEHLKSE

SEQ ID NO: 773405 - protein, 156 aa, Homo sapiens
NVVFLGGAFICSMIFNKVAVTLGDVWILLATLKVLSLLWLLYYVASTTRRPHAVLYQDPHAGPLWVRGSLVLFGSCTFCLNIFRVGYDVSHIRCKSQLDLVFSVIEMVFIGVQVTGFSRPHITEDIPYLPMPCTHLPLPMPRNSHTGKYLMSQGLC

SEQ ID NO: 773406 - protein, 135 aa, Homo sapiens
RQRHPQTGQSRQAAAQWRRRAPKTTPAIRPIPPRRAPQARPLLASPLPFSKCPVASRRRRACWVTVRRLRAGAAGRARSGEADSGLRPGSCGVGARGRPEGGGLATHPAPPAPGTRPRPRILRAPGGLHLKTTCF

SEQ ID NO: 773407 - protein, 135 aa, Homo sapiens; identical to SEQ ID NO: 773406

SEQ ID NO: 773408 - protein, 135 aa, Homo sapiens; identical to SEQ ID NO: 773406

SEQ ID NO: 773409 - protein, 135 aa, Homo sapiens; identical to SEQ ID NO: 773406

SEQ ID NO: 773410 - protein, 303 aa, Homo sapiens
APRQERAVLRCGPRSLPLSDSGPGPRVAGAKSERHERAPGPVNCSGMDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNESHSFIQAGVQWHSLGLLQPPPPGFKRSSHLILLSSWDYRHAPPHLDNFSVFLLETGFHHVGQAGLKLLTSSDPPTLAS

SEQ ID NO: 773411 - protein, 119 aa, Homo sapiens
APRQERAVLRCGPRSLPLSDSGPGPRVAGAKSERHERAPGPVNCSGMDCGSVGGQRTQRLPGRQRLLFLPVGLSGRPGGSETSARRCLSALSDGLGALRPRAPAAAAACHVPHRCSSSC

SEQ ID NO: 773412 - protein, 405 aa, Homo sapiens
APRQERAVLRCGPRSLPLSDSGPGPRVAGAKSERHERAPGPVNCSGMDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAGSIFTCLTVALGFYRLWI

SEQ ID NO: 773413 - protein, 381 aa, Homo sapiens
APRQERAVLRCGPRSLPLSDSGPGPRVAGAKSERHERAPGPVNCSGMDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMYSLNEKKLLELRTEIVALHAQQDRALTQTDRKIETEVAGLKTMLESHKLDNIKYLAGSIFTCLTVALGFYRLWI

SEQ ID NO: 773414 - protein, 405 aa, Homo sapiens; identical to SEQ ID NO: 773412

SEQ ID NO: 773415 - protein, 405 aa, Homo sapiens; identical to SEQ ID NO: 773412

SEQ ID NO: 773416 - protein, 439 aa, Homo sapiens
APRQERAVLRCGPRSLPLSDSGPGPRVAGAKSERHERAPGPVNCSGMDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRGNRGEGLRVEADQLEHLSGHSEACWGNLLTFELAELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAGSIFTCLTVALGFYRLWI

SEQ ID NO: 773417 - protein, 130 aa, Homo sapiens [sequence omitted]

SEQ ID NO: 773418 - protein, 405 aa, Homo sapiens; identical to SEQ ID NO: 773412

SEQ ID NO: 773419 - protein, 405 aa, Homo sapiens; identical to SEQ ID NO: 773412

SEQ ID NO: 773420 - protein, 128 aa, Homo sapiens
VRASQLLCLPTQASAMVGAPPPTLLPPCSSISDCCASNEPGSVGVGPSEPGTGYNLLVCRFLRPLEKHSIRVGVTPFSRCHLSQLPLARKGNSLTPLHFPGEAMPRPASAHARCTAPTVLHPLSNKPQ

SEQ ID NO: 773421 - protein, 70 aa, Homo sapiens
MKLPKGTRSSVYFAQHPEKEPLPSRQEVKQTPVIMAKIKGPGPAKYLRPSCTGYIDHDISMFKAPAYTLH

SEQ ID NO: 773422 - protein, 99 aa, Homo sapiens
PVALVGPQLPEAKFPRPRSGLTVASPGSAPALRWHLQAPNGLRSVGSSRPSLGLLAASAGPNRPEVGLSRPSLGLPAASAGPSHPQIGLELGLEEQQVG

SEQ ID NO: 773423 - protein, 313 aa, Homo sapiens
NSASPETQRPGVSPERSRAKVTPRPPPAARRLRGSVCQSARASEPLAPRRSPGQPSAMNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDLVYTARPDERAIMTYVSCYYHAF

SEQ ID NO: 773424 - protein, 97 aa, Homo sapiens
FFPLFSLVSLLRLYVCGVCVCARPVLFSPPSDIVNTPKPDERAIMTYVSCFYHAFAGAEQVLNTCPSGLLCYSLLVLVVCAYLSVCLCASHLTLESF

SEQ ID NO: 773425 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 773426 - protein, 96 aa, Homo sapiens
EDLWAQSYGEGLLEFIQTLREPHSTGMMGKSRPKVRKQILEHEEIVGYSELPVVCKLETPKTVREATASEGMELFLGLRFRRTCTKERHPYQCHCS

SEQ ID NO: 773427 - protein, 92 aa, Homo sapiens
RDSHQQYLLPSIPVLVMSPSTSGCLCDQWNKAEMMLRHFQGWLIKDTVTSALFFPPWVTLGKASCYAARTLKRPMRRAMWQGTEAACPHPCE

SEQ ID NO: 773428 - protein, 92 aa, Homo sapiens; identical to SEQ ID NO: 773427

SEQ ID NO: 773429 - protein, 109 aa, Homo sapiens
GLLQCLPFLKTLSLWLIQASRLKTSDLFVSFVPVTKPTFFSLCRASCLLLLHLFLLAFSRVPRQPQRSPNCFFWLGLGSLLQAFLSQSTNGIFLNLVSLSNFKKPSDFL

SEQ ID NO: 773430 - protein, 237 aa, Homo sapiens
STQSWDTQAYRAHRLTGHTVTGHTGSQGTESGATQAHGAQSHGAQTHRLTDHRGSWGAGSQGTQTHRAHRLTGHTGSQGTQSHGAQRLTGHRLTGTGSRGTDLPDTQVMGHRVMGHTGSQGTQAHGTQSHGTHRLTGHTGSQDTQVHGAQSHGAQTHRLTGHRRSWGAGSQGTQTHRAHRLMGHRVTGHRLTNSQVTEAHGVQAHRAHRLTGHTGSWGTESQGTDSQGTQAHRTHRL

SEQ ID NO: 773431 - protein, 69 aa, Homo sapiens
GRDGPTLLTPLSTCKGTCECICMLICMLICMLVCLLICMLVCMLIYLLVCVVICVLVCELICVLVCVLV

SEQ ID NO: 773432 - protein, 131 aa, Homo sapiens
TTTTKFAAASTEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQ

SEQ ID NO: 773433 - protein, 105 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEVLLDPFLEVLLLNRSRGEFEI

SEQ ID NO: 773434 - protein, 117 aa, Homo sapiens
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 773435 - protein, 108 aa, Homo sapiens
MSQKQEEENPAEETGEEKQDTQEKEGILPERAEEAKLKAKYPSLGQKPGGSDFLMKRLQKGQQVLVTQETTTWPKNVTETAAASPPDMIWSDVSMPHDTIKPQKFSYP

SEQ ID NO: 773436 - protein, 117 aa, Homo sapiens; identical to SEQ ID NO: 773434

SEQ ID NO: 773437 - protein, 117 aa, Homo sapiens; identical to SEQ ID NO: 773434

SEQ ID NO: 773438 - protein, 142 aa, Homo sapiens
GGGPGVNRTRRWLPGPLTLHSPGPAMSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 773439 - protein, 148 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEVLLDPFLEQKYFDSGDYNMAKAKMKNKQLPSAGPDKNLVTGDHIPTPQDLPQRKSSLVTSKLAG

SEQ ID NO: 773440 - protein, 133 aa, Homo sapiens
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAG

SEQ ID NO: 773441 - protein, 117 aa, Homo sapiens; identical to SEQ ID NO: 773434

SEQ ID NO: 773442 - protein, 117 aa, Homo sapiens; identical to SEQ ID NO: 773434

SEQ ID NO: 773443 - protein, 117 aa, Homo sapiens; identical to SEQ ID NO: 773434

SEQ ID NO: 773444 - protein, 117 aa, Homo sapiens; identical to SEQ ID NO: 773434

SEQ ID NO: 773445 - protein, 131 aa, Homo sapiens
DVGRVVGKTVNGKGMAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 773446 - protein, 137 aa, Homo sapiens
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGGQVE

SEQ ID NO: 773447 - protein, 133 aa, Homo sapiens
HNWDRTSPSSQSIVSHIPDNSISILYHTSPHTTLVFPPTFSLQLLQIQPLYVPLQSLFPFLRVTDQSVEVHQPHPPWTPNIFSAPLWPVSPSLAPGSTRFLHLRSSQILYFFSFLSELPSLSFSLSPQDYWSQ

SEQ ID NO: 773448 - protein, 121 aa, Homo sapiens
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 773449 - protein, 121 aa, Homo sapiens; identical to SEQ ID NO: 773448

SEQ ID NO: 773450 - protein, 117 aa, Homo sapiens; identical to SEQ ID NO: 773434

SEQ ID NO: 773451 - protein, 104 aa, Homo sapiens
MRILTHNKFRVDVEGGNQDTQEKEGILPERAEEAKLKAKYPSLGQKPGGSDFLMKRLQKGVWGIVSYPLSLELKEVLRMKSVEVLLDPFLEVLLLNRSRGEFEI

SEQ ID NO: 773452 - protein, 127 aa, Homo sapiens
DVGRVVGKTVNGKGMAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 773453 - protein, 117 aa, Homo sapiens; identical to SEQ ID NO: 773434

SEQ ID NO: 773454 - protein, 117 aa, Homo sapiens; identical to SEQ ID NO: 773434

SEQ ID NO: 773455 - protein, 117 aa, Homo sapiens; identical to SEQ ID NO: 773434

SEQ ID NO: 773456 - protein, 121 aa, Homo sapiens; identical to SEQ ID NO: 773448

SEQ ID NO: 773457 - protein, 117 aa, Homo sapiens; identical to SEQ ID NO: 773434

SEQ ID NO: 773458 - protein, 113 aa, Homo sapiens
TCGVNTWTWCLDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 773459 - protein, 178 aa, Homo sapiens
LLDPFLEQKYFDSGDYNMAKAKMKNKQLPSAGPDKNLVTGDHIPTPQDLPQRKSSLVTSKLRVAKLNDAARGSARGSDFLMKRLQKGVWGIVSYPLSLELKEVLRMKSVEVLLDPFLEQKYFDSGDYNMAKAKMKNKQLPSAGPDKNLVTGDHIPTPQDLPQRKSSLVTSKLAGGQVE

SEQ ID NO: 773460 - protein, 105 aa, Homo sapiens; identical to SEQ ID NO: 773433

SEQ ID NO: 773461 - protein, 133 aa, Homo sapiens
LRTLPTAKVFISLPPNLDFKVAPSILKPRKAPALLCLRGPQLEVPCCLCPLKSEQFLAPVGRSRPKANSRPDCDKPRTEACPMKRLSPLKPLPLVGTFQRRRGLGDMKLGKPLLRFPTALVLDPTPNKKKQVK

SEQ ID NO: 773462 - protein, 447 aa, Homo sapiens
LGPWPSLSRMGRVEDGGTTEELEDWDPGTSALPAPGIKQGPREQTGTGPLSQKCWEPEPDAPSQPGPALWSRGRARTQALAGGSSLQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 773463 - protein, 342 aa, Homo sapiens
VTRPKRGAERSGRSGPAGAERSRPQSSPSRPRPPTPDPGPRPGSMDRSSLLQLIQEQQLDPENTGFIGADTFTGLVHSHELPLDPAKLDMLVALAQSNEQGQVCYQELVDLIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 773464 - protein, 471 aa, Homo sapiens
VTRPKRGAERSGRSGPAGAERSRPQSSPSRPRPPTPDPGPRPGSMDRSSLLQLIQEQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMVTGLPGGGRGEGPQVSLTTSRLHTPIELGWDEMSLQVAEDGAGLGVQLSEGPGGGPGGLSACSQGTSHLPRPSAVSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 773465 - protein, 417 aa, Homo sapiens
VTRPKRGAERSGRSGPAGAERSRPQSSPSRPRPPTPDPGPRPGSMDRSSLLQLIQEQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 773466 - protein, 78 aa, Homo sapiens
VTRPKRGAERSGRSGPAGAERSRPQSSPSRPRPPTPDPGPRPGSMDRSSLLQLIQEQVRRGVVWGAGTAPNAALLPLS

SEQ ID NO: 773467 - protein, 107 aa, Homo sapiens
LCLLRPRLCAPRLTGHGAPPLGPQDEPKLKTIPPTQVVPAGLGFPTHLAPPSPLCAQTHACMHSHTVPSPRTLPLMPLVSPSKPNVKCSLLHESLPNPPTFGASPVA

SEQ ID NO: 773468 - protein, 83 aa, Homo sapiens
MKQCWIDPTCTQRRKAAGETSSEERDSGSNPRIQATCVGLRVACVCFHAQHQDLSTESFPYLPWDPGIKVLPEGFSTMWSIVH

SEQ ID NO: 773469 - protein, 108 aa, Homo sapiens
FEEEVMSPHLQAWALLLCEQGQGPQEASQSLFLPPNLGCSGPTDSPGSGCHVLSGATMKFPAALMASGMLVHVTGRGSLWVVTSPAASDELRGTFSSLCQMTSLSPTL

SEQ ID NO: 773470 - protein, 98 aa, Homo sapiens
NFSLGSINQRLNKRERSKLKNLRRKQRRRERWLQKQGKYSGVGLLDHMTLNNEMSTDEDNEYAEEKDSYICAVCLDVYFNPYMCYPCHHIFCEPCLRT

SEQ ID NO: 773471 - protein, 144 aa, Homo sapiens
MECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARVRPLPW

SEQ ID NO: 773472 - protein, 223 aa, Homo sapiens
MECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGHGFGSSKMSRAQTFPSYAPEQSEEAQQPLSRSSSYGFSYSSSLIQ

SEQ ID NO: 773473 - protein, 402 aa, Homo sapiens
APFPVRGGPAGDPASPPAGARGRAGGGAAAGGGRLDARPAQTRRRTAALDSGERIAGRRSPIALAMASNFNDIVKQGYVKIRSRKLGIFRRCWLVFKKASSKGPRRLEKFPDEKAAYFRNFHKVTELHNIKNITRLPRETKKHAVAIIFHDETSKTFACESELEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGNHENRHSDLTGKSCKKSENRFLEENAPLVMYGITHHLFMDTSTCKVVHDLE

SEQ ID NO: 773474 - protein, 229 aa, Homo sapiens
MECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGNHENRHSDLTGKSCKKSENRFLEENAPLVMYGITHHLFMDTSTCKVVHDLE

SEQ ID NO: 773475 - protein, 396 aa, Homo sapiens
APFPVRGGPAGDPASPPAGARGRAGGGAAAGGGRLDARPAQTRRRTAALDSGERIAGRRSPIALAMASNFNDIVKQGYVKIRSRKLGIFRRCWLVFKKASSKGPRRLEKFPDEKAAYFRNFHKVTELHNIKNITRLPRETKKHAVAIIFHDETSKTFACESELEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGHGFGSSKMSRAQTFPSYAPEQSEEAQQPLSRSSSYGFSYSSSLIQ

SEQ ID NO: 773476 - protein, 504 aa, Homo sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 773477 - protein, 344 aa, Homo sapiens
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRYGKPGCNAETCDYFLSYRMIGADVEFELSADTDGWVAVGFSSDKKMGGDDVMACVHDDNGRVRIQHFYNVGQWAKEIQRNPARDEEGVFENNRVTCRFKRPVNVPRDETIVDLHLSWYYLFAWGPAIQGSITRHDIDSPPASERVVSIYKYEDIFMPSAAYQTFSSPFCLLLIVALTFYLLMGTP

SEQ ID NO: 773478 - protein, 174 aa, Homo sapiens
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRQDSAFLISSLVMLVH

SEQ ID NO: 773479 - protein, 186 aa, Homo sapiens
VQHGRRGLVVVLRLPIALPLHGDVAGIEAFDQAGQADLVLGQLIPGWGQGVHLWFSGLPFGFGDGFLDGGWEGFVGDLALVLLAIQPVLVQDGEDADHTVRAVVLLLPRLCLGIMHLHAVHVPVELDLRVFVAHVHHHAHVHCTLYDDAPRPYLAFLRYDYRDLLPSLRSWPRRYLCTEVSHHPCR

SEQ ID NO: 773480 - protein, 95 aa, Homo sapiens
TWDGLEKLRYSHGATGLLGGSSGGQGRPPLSHSRGTLCGLLQWGLAGSDAGGWAVGTHLGDRHVTQAVDPKTWERGCGKAGASASGPHPPRILGR

SEQ ID NO: 773481 - protein, 110 aa, Homo sapiens
MFLASWLLFCIVAPKDDAHLSFIQCKDIWKDNRKYSCFHFKSDQLLELASKACTSFQAQSRSFTAGAVPSEHPELPCGSQQLCCGCTARLGGRWIGASRCGSGSAFLASP

SEQ ID NO: 773482 - protein, 171 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGH

SEQ ID NO: 773483 - protein, 119 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKASPPTSNHPESPVNSFVIQSGITSCP

SEQ ID NO: 773484 - protein, 171 aa, Homo sapiens; identical to SEQ ID NO: 773482

SEQ ID NO: 773485 - protein, 171 aa, Homo sapiens; identical to SEQ ID NO: 773482

SEQ ID NO: 773486 - protein, 210 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGGRTHQKRGVCWSCLNRYFFLFLGIVDSSPSQAHVQRHVSC

SEQ ID NO: 773487 - protein, 109 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAWGEERTKNVVCAGVV

SEQ ID NO: 773488 - protein, 171 aa, Homo sapiens; identical to SEQ ID NO: 773482

SEQ ID NO: 773489 - protein, 74 aa, Homo sapiens
RQLPGALPCSLTPERRSSDPDTREALSFQHHKLGLRREDSWPSSSSSNWLESALTPHECSTVWEERRKDGEAEQ

SEQ ID NO: 773490 - protein, 171 aa, Homo sapiens; identical to SEQ ID NO: 773482

SEQ ID NO: 773491 - protein, 171 aa, Homo sapiens; identical to SEQ ID NO: 773482

SEQ ID NO: 773492 - protein, 171 aa, Homo sapiens; identical to SEQ ID NO: 773482

SEQ ID NO: 773493 - protein, 119 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKLPQPPITLSHL

SEQ ID NO: 773494 - protein, 102 aa, Homo sapiens
MVKLNSNPSEKGTKPPSVEDGFQTVPLITPLEVNHLQLPAPEKVIVKTRTEYQPEQKNKGKFRVPKIAEFTVMSATQHRPSESGPRPSCVQVLAGISRYLHE

SEQ ID NO: 773495 - protein, 110 aa, Homo sapiens
MAKHHPDLIFCRKQAGVAIGRLCEKCDGKCVICDSYVRPCTLVRICDECNYGSYQGRCVICGGPGVSDAYYCKECTIQEKDRDGCPKIVNLGSSKTDLFYERKKYGFKKR

SEQ ID NO: 773496 - protein, 110 aa, Homo sapiens; identical to SEQ ID NO: 773495

SEQ ID NO: 773497 - protein, 110 aa, Homo sapiens; identical to SEQ ID NO: 773495

SEQ ID NO: 773498 - protein, 110 aa, Homo sapiens; identical to SEQ ID NO: 773495

SEQ ID NO: 773499 - protein, 110 aa, Homo sapiens; identical to SEQ ID NO: 773495

SEQ ID NO: 773500 - protein, 110 aa, Homo sapiens; identical to SEQ ID NO: 773495

SEQ ID NO: 773501 - protein, 127 aa, Homo sapiens
QRNLKQVMSVPGREPSTSFPCSPGQKPHSSLWLHSPVSRAPASVQLPPGNLPSSHDYLCPSHSCFSLFPNIKTLPVSGYCPCSYTMYLNDDSTVPFSSFRSRLRDVSHALPPPSEDSSACQSLTLLR

SEQ ID NO: 773502 - protein, 81 aa, Homo sapiens
MSHIAYHCHTSLNVTRHCQCQCHTVPYIPHRHTMSHIVTNRFHTMSVSQHCVTQCHSVHTSVSQCHSMSYSSHIVHCHNIT

SEQ ID NO: 773503 - protein, 124 aa, Homo sapiens
RVSTDQQLKGSVSQDCSLLQMPVPSLGCQGTHTSVQLGYQPGGSHGPLLRFNNVIKAHRTQGNVTYVKDTNQQQHEEVHRAMSGMSPLQELLFPWNLEGTTLPIHGCIHQPGSSLNSPHTPAIS

SEQ ID NO: 773504 - protein, 1255 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDERAVPLLGYLPQDLIETPVLVQLHPSDRPLMLAIHKKILQSGGQPFDYSPIRFRARNGEYITLDTSWSSFINPWSRKISFIIGRHKVRVGPLNEDVFAAHPCTEEKALHPSIQELTEQIHRLLLQPVPHSGSSGYGSLGSNGSHEHLMSQTSSSDSNGHEDSRRRRAEICKNGNKTKNRSHYSHESGEQKKKSVTEMQTNPPAEKKAVPAMEKDSLGVSFPEELACKNQPTCSYQQISCLDSVIRYLESCNEAATLKRKCEFPANVPALRSSDKRKATVSPGPHAGEAEPPSRVNSRTGVGTHLTSLALPGKAESVASLTSQCSYSSTIVHVGDKKPQPELEMVEDAASGPESLDCLAGPALACGLSQEKEPFKKLGLTKEVLAAHTQKEEQSFLQKFKEIRKLSIFQSHCHYYLQERSKGQPSERTAPGLRNTSGIDSPWKKTGKNRKLKSKRVKPRDSSESTGSGGPVSARPPLVGLNATAWSPSDTSQSSCPAVPFPAPVPAAYSLPVFPAPGTVAAPPAPPHASFTVPAVPVDLQHQFAVQPPPFPAPLAPVMAFMLPSYSFPSGTPNLPQAFFPSQPQFPSHPTLTSEMASASQPEFPSRTSIPRQPCACPATRATPPSAMGRASPPLFQSRSSSPLQLNLLQLEEAPEGGTGAMGTTGATETAAVGADCKPGTSRDQQPKAPLTRDEPSDTQNSDALSTSSGLLNLLLNEDLCSASGSAASESLGSGSLGCDASPSGAGSSDTSHTSKYFGSIDSSENNHKAKMNTGMEESEHFIKCVLQDPIWLLMADADSSVMMTYQLPSRNLEAVLKEDREKLKLLQKLQPRFTESQKQELREVHQWMQTGGLPAAIDVAECVYCENKEKGNICIPYEEDIPSLGLSEVSDTKEDENGSPLNHRIEEQT

SEQ ID NO: 773505 - protein, 1219 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVEKVLQSGGQPFDYSPIRFRARNGEYITLDTSWSSFINPWSRKISFIIGRHKVRVGPLNEDVFAAHPCTEEKALHPSIQELTEQIHRLLLQPVPHSGSSGYGSLGSNGSHEHLMSQTSSSDSNGHEDSRRRRAEICKNGNKTKNRSHYSHESGEQKKKSVTEMQTNPPAEKKAVPAMEKDSLGVSFPEELACKNQPTCSYQQISCLDSVIRYLESCNEAATLKRKCEFPANVPALRSSDKRKATVSPGPHAGEAEPPSRVNSRTGVGTHLTSLALPGKAESVASLTSQCSYSSTIVHVGDKKPQPELEMVEDAASGPESLDCLAGPALACGLSQEKEPFKKLGLTKEVLAAHTQKEEQSFLQKFKEIRKLSIFQSHCHYYLQERSKGQPSERTAPGLRNTSGIDSPWKKTGKNRKLKSKRVKPRDSSESTGSGGPVSARPPLVGLNATAWSPSDTSQSSCPAVPFPAPVPAAYSLPVFPAPGTVAAPPAPPHASFTVPAVPVDLQHQFAVQPPPFPAPLAPVMAFMLPSYSFPSGTPNLPQAFFPSQPQFPSHPTLTSEMASASQPEFPSRTSIPRQPCACPATRATPPSAMGRASPPLFQSRSSSPLQLNLLQLEEAPEGGTGAMGTTGATETAAVGADCKPGTSRDQQPKAPLTRDEPSDTQNSDALSTSSGLLNLLLNEDLCSASGSAASESLGSGSLGCDASPSGAGSSDTSHTSKYFGSIDSSENNHKAKMNTGMEESEHFIKCVLQDPIWLLMADADSSVMMTYQLPSRNLEAVLKEDREKLKLLQKLQPRFTESQKQELREVHQWMQTGGLPAAIDVAECVYCENKEKGNICIPYEEDIPSLGLSEVSDTKEDENGSPLNHRIEEQT

SEQ ID NO: 773506 - protein, 1219 aa, Homo sapiens; identical to SEQ ID NO: 773505

SEQ ID NO: 773507 - protein, 1219 aa, Homo sapiens; identical to SEQ ID NO: 773505

SEQ ID NO: 773508 - protein, 752 aa, Homo sapiens [sequence omitted]

SEQ ID NO: 773509 - protein, 203 aa, Homo sapiens
LLKGRGDEAQIEKRIQEIIEQLDVTTSEYEKEKLNARLAKLSDGVASINTGVYQMPPENNHKAKMNTGMEESEHFIKCVLQDPIWLLMADADSSVMMTYQLPSRNLEAVLKEDREKLKLLQKLQPRFTESQKQELREVHQWMQTGGLPAAIDVAECVYCENKEKGNICIPYEEDIPSLGLSEVSDTKEDENGSPLNHRIEEQT

SEQ ID NO: 773510 - protein, 1219 aa, Homo sapiens; identical to SEQ ID NO: 773505

SEQ ID NO: 773511 - protein, 1159 aa, Homo sapiens
LALQTRTCSAEAASPELDPEPGLGDPSSHLRPAFQISQPPAMETFFRRHFRGKVPGPGEGQRRPSSVGLPTGKARRRSPAGQASSSLAQRRRSSAQLQGCLLSCGVRAQCSSRRRSSTVPPSCNPRFIVDKVLTPQPTTVGAQLLGAPLLLTGLVGMNEEEGVQEDVVAEASSAIQPGTKTPGPPPPRGAQPLLPLPRYLRRASSHLLPADAVYDHALWGLHGYYRRLSQRRPSGQHPGPGGRRASGTTAGTMLPTRVRPLSRRRQVALRRKAAGPQAWSALLAKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773512 - protein, 144 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKE

SEQ ID NO: 773513 - protein, 149 aa, Homo sapiens
GRTMAEGQGGGGQRWDWAGGGRAAEEEVVRRRCRRGEEAQVAQPWPEGSRGTAAGPPVEERFRQLHLRKQVSYRYRRTWAEGSAAPGTTPLAGVIAQTFIVRPPPAWRWEFRDDCRGISVFSCTAGRRQLLRLLLCLNRESRIHPICGG

SEQ ID NO: 773514 - protein, 126 aa, Homo sapiens
LADGAQSRGAHHDERVVGSEARPLPPAASSPCGASSVLVPPTPSSLPSLAPTLSQPGLCFSQQEPDGAGAKSPTCQKLSLPFPTWGLSLPSALWPGVTLTFVLWLEFLLRKEQSLGPPCPQPWCHL

SEQ ID NO: 773515 - protein, 924 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773516 - protein, 898 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773517 - protein, 685 aa, Homo sapiens
SPTPLLPLQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773518 - protein, 955 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVSSPHGPAEHQGWACSRGPCGPDLPLFFLPQVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773519 - protein, 360 aa, Homo sapiens
MAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773520 - protein, 864 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDPVEENGETTPLSCTKS

SEQ ID NO: 773521 - protein, 117 aa, Homo sapiens
QTVCVIGRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773522 - protein, 225 aa, Homo sapiens
MAPSRGFLAQSTCPWCLERSRSEEALLQGLVTSAAREPTGCGVRGPSSGVLQRDPQRQLRSKMCERTRFRPVLVYPAVGQRVSSGKEGWPQEVQPCHASCPQLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773523 - protein, 302 aa, Homo sapiens
MAPSRGFLAQSTCPWCLERSRSEEALLQGLVTSAAREPTGCGVRGPSSGVLQRDPQRQLRSKMCERTRFRPVLVYPAVGQRVSSGKEGWPQEVQPCHASCPQLQELHRAGGDLMHRDEQSRTLLHHAVSTGSKDVVRYLLDHAPPEILDAVEEKKYLGSAEPWSPRKPPFSPPLPFCQVRAHKLPGHICHPLGHPYCPRALNFLPFLMALGRQMGGSGDGMGYTASPCSPSGETCLHQAAALGQRTICHYIVEAGASLMKTDQQGDTPRQRAEKAQDTELAAYLENRQHYQMIQREDQETAV

SEQ ID NO: 773524 - protein, 144 aa, Homo sapiens
MPPPKEPPRPRAGLRSWGGLTCSPEDPAGPGGSQGTRHGWVGYAFAGVLGQGAPWPQQMPSQEWRGWRGGGLREEASWAPWSSAGSPAPAPAPPHLLRASSRKLSACCTCLPCLAWHPLRRPSPLPCHFIADCAAWGWGAGLSR

SEQ ID NO: 773525 - protein, 171 aa, Homo sapiens
GRTMAEGQGGGGQRWDWAGGGRAAEEEVVRRRCRRGEEAQVAQPWPEGSRGTAAGPPVEERFRQLHLRKQVSYRKAITKSGLQHLAPPPPTPGAPCSESERQIRSTVDWSESATYGEHIWFETNVSGDFCYVGEQYCVARMLQKSVSRRKCAACKIVVHTPCIEQLEKVGG

SEQ ID NO: 773526 - protein, 71 aa, Homo sapiens
RFLQPRVLSRVGSPQDCAPAHPSPSEIFPLLPQPTFVRHHWVHRRRQDGKCRHCGKVRGPARGHRHLHLRA

SEQ ID NO: 773527 - protein, 141 aa, Homo sapiens
FLLCGLVRSGPEMVREGTKREQSHPGGLLRMMVGCPGREGAYSLSPCLPGGPLETLHHQAHPLPAHEAPAGVCEPQEWGQPGERGLASQLRARAGVGVQPVCQQLFPEPVSGFYPNPSFPGILRKSCPFSTPHPLLALVPT

SEQ ID NO: 773528 - protein, 929 aa, Homo sapiens
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773529 - protein, 255 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVKQRGHQPLDIGRGQKHEEQKEGYRE

SEQ ID NO: 773530 - protein, 132 aa, Homo sapiens
LVTRRSLCGVQPAAEQVLCSPAVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSQRASGSSDRPQQ

SEQ ID NO: 773531 - protein, 82 aa, Homo sapiens
IQVRPQLRTDMHHHHERIPGTTTTNSLPSLAPTLSQPGLCFSQQEPDGAGAKSPTCQKLSPKWCFLDGESTPRVPSCFVFPP

SEQ ID NO: 773532 - protein, 1023 aa, Homo sapiens
GRTMAEGQGGGGQRWDWAGGGRAAEEEVVRRRCRRGEEAQVAQPWPEGSRGTAAGPPVEERFRQLHLRKQVSYRKAITKSGLQHLAPPPPTPGAPCSESERQIRSTVDWSESATYGEHIWFETNVSGDFCYVGEQYCVARMLQKSVSRRKCAACKIVVHTPCIEQLEKVVGSSALPAPALWVLRPFQRALTPTCYTNGLPGVTQHSGVKSQGPWSQMPAFESWLSLISCCIPTAWNKPGAQWINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773533 - protein, 707 aa, Homo sapiens
MLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773534 - protein, 414 aa, Homo sapiens
FWHVGDLTPAPSGSCWSLSMCTRQSSRSLSPGTTTEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773535 - protein, 905 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAY

SEQ ID NO: 773536 - protein, 147 aa, Homo sapiens
DPPAAALLQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 773537 - protein, 787 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSHDDDEFRHDDDEFQHDDDECRHH

SEQ ID NO: 773538 - protein, 198 aa, Homo sapiens
LLSTSCTEYWLCSGPPTGSRRDNAARGRAPSLPTSLPHSSGTATGGPRPQGKSPMPPPKEPPRPRAGLRSWGGLTCSPEDPAGPGGSQGTRHGWVGYAFAGVLGQGAPWPQQMPSQEWRGWRGGGLREEASWAPWSSAGSPAPAPAPPHLLRASSRKLSACCTCLPCLAWHPLRRPSPLPCHFIADCAAWGWGAGLSR

SEQ ID NO: 773539 - protein, 595 aa, Homo sapiens
GGSCNESSALGPVEALGTEEGERPGSLRQMWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLVSGPWAHGAWEHSPKVEGVTHTHLHGPRRP

SEQ ID NO: 773540 - protein, 871 aa, Homo sapiens
KEQEAAQAEREELAAGRMPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSQPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQCLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIQSLRRELQMVKETLQAMILQLQPAKEAGEREAAASCMTAGVHEAQA

SEQ ID NO: 773541 - protein, 849 aa, Homo sapiens
KEQEAAQAEREELAAGRMPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSQPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQCLQLQEARGSLSVEDERQMDDLEGAAPPIPPRLHSEDKRKTPLKESYILSAELGEKCEDIGKKLLYLEDQLHTAIHSHDEDLIQSLRRELQMVKETLQAMILQLQPAKEAGEREAAASCMTAGVHEAQA

SEQ ID NO: 773542 - protein, 366 aa, Homo sapiens
MHAHYRKHRKLQTSSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSQPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKGEF

SEQ ID NO: 773543 - protein, 186 aa, Homo sapiens [sequence omitted]

SEQ ID NO: 773544 - protein, 420 aa, Homo sapiens
MEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQCLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIQSLRRELQMVKETLQAMILQLQPAKEAGEREAAASCMTAGVHEAQA

SEQ ID NO: 773545 - protein, 147 aa, Homo sapiens
MVLFFLFFPGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASW

SEQ ID NO: 773546 - protein, 708 aa, Homo sapiens
HRLGSEAACESAEAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773547 - protein, 651 aa, Homo sapiens
MWNAPLNAWRYVTVLIGTECEMLYSPATDTQFRSDQIITAAEEGMGMERGKLSLSGTSASQTQASVLHLCNVLILQTRKAAREEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQAKSYQPWKHHCSLLPVTVAKLYHGGGEARGRSGWGSEPQPGPEQADAGCARHDGQLPPQRPGGAARGRR

SEQ ID NO: 773548 - protein, 93 aa, Homo sapiens
IYRSLIRPGHPGGAEPRQRQRVYPKCTWLTTPKSTWPRYSKPGLSMRLLESKKGLSFFAFEHSEEYQQAQHKFLVAVESMEPNNIVVRGPCSP

SEQ ID NO: 773549 - protein, 676 aa, Homo sapiens
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773550 - protein, 605 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPVREKG

SEQ ID NO: 773551 - protein, 743 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQVRVTQWKQAKSYQPWKHHCSLLPVTVAKLYHGGGEARGRSGWGSEPQPGPEQADAGCARHDGQLPPQRPGGAARGRR

SEQ ID NO: 773552 - protein, 688 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773553 - protein, 703 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773554 - protein, 642 aa, Homo sapiens
ASSDPYHFLGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773555 - protein, 441 aa, Homo sapiens
MRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773556 - protein, 657 aa, Homo sapiens
ARGSQTLVGTREQRKGRGLAVRSQTLWHQGTKEGVSVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773557 - protein, 740 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDRFELINIDDLEDDPVVNGERSGCALTDAVAPGNKGTGQRGNTESKTDGDDIRD

SEQ ID NO: 773558 - protein, 683 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQVRVTQWKQVCSEVGKTY

SEQ ID NO: 773559 - protein, 642 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERTKKQRTSTILEGSKI

SEQ ID NO: 773560 - protein, 605 aa, Homo sapiens; identical to SEQ ID NO: 773550

SEQ ID NO: 773561 - protein, 681 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773562 - protein, 570 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENR

SEQ ID NO: 773563 - protein, 619 aa, Homo sapiens
MWNAPLNAWRYVTVLIGTECEMLYSPATDTQFRSDQIITAAEEGMGMERGKLSLSGTSASQTQASVLHLCNVLILQTRKAAREEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773564 - protein, 368 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENR

SEQ ID NO: 773565 - protein, 355 aa, Homo sapiens
LEDLSSRAVGLRLITQTENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773566 - protein, 310 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVRGPCSP

SEQ ID NO: 773567 - protein, 243 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRDRVLLGCPVWF

SEQ ID NO: 773568 - protein, 84 aa, Homo sapiens
ATDATLPQLSPISHGNTIALFFRSLLPNYTMEGERPEEGVAGGLNRNQGLNRLMLAVRDMMANFHLNDLEAPHEDDAEGEGEWD

SEQ ID NO: 773569 - protein, 108 aa, Homo sapiens
HRLGSEAACESAEAEFSALPSPSLQTSWSFGPMSRRALRRLRGEQRGQEPLGPGALHFDLRDDDDAEEEGPKRELGVRRPGGAGKEGVRVNNRFELEKWTFSSPPKKR

SEQ ID NO: 773570 - protein, 169 aa, Homo sapiens
HRLGSEAACESAEAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKHRKKLVPNSARAR

SEQ ID NO: 773571 - protein, 256 aa, Homo sapiens
HRLGSEAACESAEAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRARRDTCVPKCLADTLKTGR

SEQ ID NO: 773572 - protein, 703 aa, Homo sapiens; identical to SEQ ID NO: 773553

SEQ ID NO: 773573 - protein, 676 aa, Homo sapiens; identical to SEQ ID NO: 773549

SEQ ID NO: 773574 - protein, 703 aa, Homo sapiens; identical to SEQ ID NO: 773553

SEQ ID NO: 773575 - protein, 703 aa, Homo sapiens; identical to SEQ ID NO: 773553

SEQ ID NO: 773576 - protein, 703 aa, Homo sapiens; identical to SEQ ID NO: 773553

SEQ ID NO: 773577 - protein, 684 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGEGCGCWAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773578 - protein, 551 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEIRSEPQPGPEQADAGCARHDGQLPPQRPGGAARGRR

SEQ ID NO: 773579 - protein, 538 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISCARHDGQLPPQRPGGAARGRR

SEQ ID NO: 773580 - protein, 605 aa, Homo sapiens; identical to SEQ ID NO: 773550

SEQ ID NO: 773581 - protein, 605 aa, Homo sapiens; identical to SEQ ID NO: 773550

SEQ ID NO: 773582 - protein, 672 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRPRQRQRVYPKCTWLTTPKSTWPRYSKPGEGCGCWAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773583 - protein, 435 aa, Homo sapiens
EECAGAPTAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRRGDRKAV

SEQ ID NO: 773584 - protein, 362 aa, Homo sapiens
DAEGDSKDPSYLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773585 - protein, 336 aa, Homo sapiens
MSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773586 - protein, 123 aa, Homo sapiens
ECRLYANLNYILEVEKKYFRDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 773587 - protein, 243 aa, Homo sapiens; identical to SEQ ID NO: 773567

SEQ ID NO: 773588 - protein, 189 aa, Homo sapiens
HRLGSEAACESAEAEFSALPSPSLQTSWSFGPMSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASGWGRSKDSPILYVY

SEQ ID NO: 773589 - protein, 105 aa, Homo sapiens
SFYLALYKQMSFLEKRGCPRTALEYCKLILRWVSAQGQARPRSLSWLQAHSQPDDAPVPLCSALCAASGSLEPDEDPLCMLLLIDHLALRARNYEYLIRLFQEWE

SEQ ID NO: 773590 - protein, 306 aa, Homo sapiens
ESPMCNRYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAMQEAEQRGELALKDAQKKLGDLDVALTQAKEDLTRLLRDYQELMNVKLALDVEIATYRKLLESEESRMSGECPSGVSISVTGNPPLCAEVAQPAEEVASTRDGNEGAPKGDTETNDGHRNRQGGQNPRHHNTEKTQGQESAEV

SEQ ID NO: 773591 - protein, 2516 aa, Homo sapiens
PGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLELLKDDASLWCLVVFCSAQMLREVCYNSTCDLLLSKELYSIHLCEILYHGICMYSPTWWKYHGIALHLNFFFLTFPFKSYILGWKFFQFDLIDVSVIFDINLWCIRGLYAALFILVLCFINLVFVYQLQAITIPSECGTFDYDLANCFFEPSLVRLFYSFLSYFYLGKVGFFGAIIIIYRNKVILQQLTLYFKQNVSYQFYVEMCYSIYILECLQYGTFRCVIFVWIFFSVKKLVNLNGQFKRKQMQSMEKCFHFLKMNKAKAVTVTGRALLSSYDVLLDSRSGIEFLDFHYTCIFNMSVFLFWGTTILDKITFHSTCLFLMNLIIHNATFIFNILFSFPAIYQGWPEVGLCVEVMQHFLILHYREMVMEELYMVTYNFCKILYIFHFPEGSFLGGACYIIKARLLPQIVYFRYRLRSVLVLVRDISGFKVMGFASGEYISAEEKIDFAVSGRQLCDVTSLDCCVQVLNCTSRNRCIQIFFCSLLRCPGYSDYPTCYSLKEALKNQKVPFTVDTNCIFLTIRTILICRSSYKHKYVTMIRLLGNILSLIEIQIFKVKLRSENRLENKNNNLDEIEMSVLVLYNILKTVNKFIGIFFLLKLTYCELKIKVKMLPENNVQAPLTEDNIFTTCVTLCVARSRIWVYSEMLLKGIVHIDITNNLNLFSKLNSGKWYSTQLLLLCLKGVWHSSVSRNNMGEATQPILSGVCLKATLLACEIVLLDLVTYKASLNVEANSVPKTGLQMCSIFYFSHILRLLFSMKSLLNYTCRFCFHFLHFTILIISTFAKFYIYLNEILGEMCVTFEFDLLVLLADYFVIASWILNYGKIVEPAATSTEVSSSELPTLKSFSVINYEFKNEQFSYVKRTVCPLFLKHRCCVQSCRMRELADFRYSKFLLIYSNKSKESIIKLNPELITSLHFSQNFLSEPNLLPDLLINNQRDVLISEVARNGQLIGKKKDSDWSILPLNNGQLTVLYTVTSQSVVSVSESRGNSTQLAKYWPLVSPPFLHGYRRFQSCFYDLSLYPDKSLSLTYTFGRNAHQCNIFDTGGNLNLCFYENSFMRICNITEEYFMYIYIHKYVFVMRYEKQGLGGVLLMANFSLIKLCFFEFERPSLGSGRPMIRFRTTWMESSSSLVLFLVFSKNYFDIFNRMCNFKIHKKLKVVLIIQKLFNMSYGCIYMYIDSNIFIKQIYFAYVIALQFVTGGRMALGVCVCVCVCVCVCVCFENSQAVFPLIYNGIYFKVCLVFIILLLSNFLIQDKIRHTVFWPFCWCVVHPFYCHLTPGEFPRDLKSKDSGWTYAYVPNILKMLIQLTVKFPRYTPTNKDEVLKRDGLHTCIRIRENSSVNKSKETYTIFSPLGQGLTFSVKDQIVNNTGIIWTSNAIVKTTQLCLQSIRTAQITCKLVWLCSNKTLFTETGSGQIGPVGHNLLISSSKSWYMLIEEIIIAFQLTLKENLVVFDVLQKRIVRHLMLKHLNSFEFSYLFTPMYLLEIFLVFNHKKKHSVKMFEYVLNFFHKLFISVDKWESLTNLLFFKSLIDQKKSVAAFNYATDTFWLHLPVTFFHWFWLLINNISAFFKNDFKEDKYIVISHAIALFCKIKNCDKYNCSYNVSGMLQCNIFMRNKMYLCFVCPDLSGFLDALGLSLVNDILHMIICNFEFVEVHAAEHVYSQCFIPGVASVIIFIRTFKQHEHHHPLEIVKLSFKIGMQLEVLTMFIVFKWLLCFSLILSVNLIITPVAVLLLCIRSGFSP

SEQ ID NO: 773592 - protein, 108 aa, Homo sapiens
MYEQGSGEQDTHSSAPYHFFVDDHHFLKGLLVLGPSGMPVHWLRLSVWDVGSRLRTTRDGPWQSLVRTRSCLQFGNTTQRRYGLYTLSRLSPYSEGAALARNGPPTDK

SEQ ID NO: 773593 - protein, 106 aa, Homo sapiens
MVARDERSSLAMTPQAQLHTQVMSTALPHPHRGPLTPPLTHPPPKLWRPVAGSQSPPSPVPGTKPGTQEVLCKCSWGVAALGSKGREAGGARDGPTGADGSTTIQH

SEQ ID NO: 773594 - protein, 105 aa, Homo sapiens [sequence omitted]

SEQ ID NO: 773595 - protein, 120 aa, Homo sapiens
VFSLKAMFPVFSGCFQELQEKNKSLELVSFEEVAVHFTWEEWQDLDDAQRTLYRDVMLETYSSLVSLGHCITKPEMIFKLEQGAEPWIVEETLSLRLSGGSKKQVFSGICHRSLVELQEV

SEQ ID NO: 773596 - protein, 99 aa, Homo sapiens
VFSLKAMFPVFSGCFQELQEKNKSLELVSFEEVAVHFTWEEWQDLDDAQRTLYRDVMLETYSSLVSLGHCITKPEMIFKLEQGAEPWIVEETLSLRLSG

SEQ ID NO: 773597 - protein, 112 aa, Homo sapiens
VFSLKAMFPVFSGCFQELQEKNKSLELVSFEEVAVHFTWEEWQDLDDAQRTLYRDVMLETYSSLVSLGHCITKPEMIFKLEQGGLISLVNSGTVFPIVNWTSLRMGPQIFQT

SEQ ID NO: 773598 - protein, 102 aa, Homo sapiens
MAPKAKKEAPAPPQAEAKAKAVKAKKAVLKGVHSRKKKKIHTSPTFQRPKTLRLQGQPKYPQKSAARRNKLDHHIIIKLPLTTESAMKKSEDNKTLVFIVDV

SEQ ID NO: 773599 - protein, 229 aa, Homo sapiens
MAEEMESSLEASFSSSGAVSGASGFLPPARSRIFKIIVIGDSNVGKTCLTYRFCAGRFPDRTEATIGVDFRERAVEIDGERIKIQLWDTAGQERFRKSMVQHYYRNVHAVVFVYDMTNMASFHSLPSWIEECKQHLLANDIPRILVGNKCDLRSAIQVPTDLAQKFADTHSMPLFETSAKNPNDNDHVEAIFMTLAHKLKSHKPLMLSQPPDNGIILKPEPKPAMTCWC

SEQ ID NO: 773600 - protein, 111 aa, Homo sapiens
PPARSRIFKIIVIGDSNVGKTCLTYRFCAGRFPDRTEATIGVDFRERAVEIDGERIKVSGWGTVGEDRVTGVPTPPWAGRWPCARCVCAPFFSHADEIGVGDWKDCNTANF

SEQ ID NO: 773601 - protein, 229 aa, Homo sapiens; identical to SEQ ID NO: 773599

SEQ ID NO: 773602 - protein, 53 aa, Homo sapiens
QERFWTITSSYYRGAHGFLVVYDVTDQESYANVKQWLQEIDRHASENVNKLLV

SEQ ID NO: 773603 - protein, 34 aa, Homo sapiens
MTPPRPRPEEARRRPASLGHFRQGRSRPVVRERR

SEQ ID NO: 773604 - protein, 34 aa, Homo sapiens; identical to SEQ ID NO: 773603

SEQ ID NO: 773605 - protein, 70 aa, Homo sapiens
VCMGPASASQRTLHAQLALASLHPPQSKAPAFRPLRQAQLLPASGLFRPSSFLTTAFPGPVFPFRQPLGL

SEQ ID NO: 773606 - protein, 825 aa, Homo sapiens
TDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVEESVDRWGKCCLPWALGCRKKTPKAKYMYLAQELLVDPEWPPKPQTTTEAKALVKENGSCQIITIT

SEQ ID NO: 773607 - protein, 622 aa, Homo sapiens
MSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVENFFLDMVLWKVVFNRDKQGEYRFSTTQPPQESVDRWGKCCLPWALGCRKKTPKAKYMYLAQELLVDPEWPPKPQTTTEAKALVKENGSCQIITIT

SEQ ID NO: 773608 - protein, 825 aa, Homo sapiens; identical to SEQ ID NO: 773606

SEQ ID NO: 773609 - protein, 825 aa, Homo sapiens; identical to SEQ ID NO: 773606

SEQ ID NO: 773610 - protein, 470 aa, Homo sapiens
MSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKN

SEQ ID NO: 773611 - protein, 825 aa, Homo sapiens; identical to SEQ ID NO: 773606

SEQ ID NO: 773612 - protein, 825 aa, Homo sapiens; identical to SEQ ID NO: 773606

SEQ ID NO: 773613 - protein, 499 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLRRKQSSKHALGYTLHPPSQAVEGQHKDMVRIPVGSRETFYRISKTDGVCEWKFFSSMPRGSARITVSKDQSSCTTARTKSRSVTRLECSGMILAHCNLRLPGSRDSPASASQAAGTTGDVPPGRRHQAQLIFVFLVETGFHHVGQDDLDLLTS

SEQ ID NO: 773614 - protein, 455 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLRRKQSSKHALGYTLHPPSQAVEGQHKDMVRIPVGSRETFYRISKTDGVCEWKFFSSMPRGSARITVSKDQSSCTTARRGMDCRYFTKNCREHIKHVNFMMPPWRKGLEC

SEQ ID NO: 773615 - protein, 297 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGKS

SEQ ID NO: 773616 - protein, 466 aa, Homo sapiens [sequence omitted]

SEQ ID NO: 773617 - protein, 429 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLRRKQSSKHALGYTLHPPSQAVEGQHKDMVRIPVGSRETFYRISKTDGVCEWKFFSSMPRGSARITVSKDQSSCTTARGHTPMT

SEQ ID NO: 773618 - protein, 203 aa, Homo sapiens
QRAWWVPSTPHSLPHHTGCHTNRDAQRDLPQWSFFPDFKPSETVFKIVFWLGYLNSCINPIIYPCSSQEFKKAFQNVLRIQCLRRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 773619 - protein, 306 aa, Homo sapiens
ARAGAGLPCGAVARNRSTCRLLFPAMASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLEALLLCQRTDITKAALGVLRQSRVKTVWLVGRRGPLQVAFTIKELREMIQLPGAGPFWILWISWVSRTRSRRSPARGSG

SEQ ID NO: 773620 - protein, 228 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEQCEKEVIMGGKVMEVRIIMKKNEMERKEIKKEEMGVMRSRVKKVWIVGRSGKMKVEL

SEQ ID NO: 773621 - protein, 33 aa, Homo sapiens
MWALDEPTAFGGSDEVRDPANAKALRNKRRRMQ

SEQ ID NO: 773622 - protein, 275 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGAGPFWILWISWVSRTRSRRSPARGSG

SEQ ID NO: 773623 - protein, 272 aa, Homo sapiens
MGARGGLRALSRGRSRAGAGLEKGFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGAGPFWILWISWVSRTRSRRSPARGSG

SEQ ID NO: 773624 - protein, 275 aa, Homo sapiens; identical to SEQ ID NO: 773622

SEQ ID NO: 773625 - protein, 255 aa, Homo sapiens
PGRSGLALRSSSYGTDPLAGCCSQPWLRAAGAGGAGRRGLGPGCLPPGAPREKTPQICVVGSGPAGFYTAQHLLKHPQAHVDIYEKQPVPFGLVRFGVAPDHPEVKTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKRSPARGSG

SEQ ID NO: 773626 - protein, 275 aa, Homo sapiens; identical to SEQ ID NO: 773622

SEQ ID NO: 773627 - protein, 275 aa, Homo sapiens; identical to SEQ ID NO: 773622

SEQ ID NO: 773628 - protein, 275 aa, Homo sapiens; identical to SEQ ID NO: 773622

SEQ ID NO: 773629 - protein, 112 aa, Homo sapiens
IEDLILMRQPPNVVLITGTGYYTWLIFVFLVEMEFHYVGQAGLKLLTSGDPPASASRSVGITGVSHHAQPVWFFFYFLRWNLTLLPGWSAMARSWLTAISASWLQAILLPQP

SEQ ID NO: 773630 - protein, 228 aa, Homo sapiens
SLCYWKVACPPLAGTMQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 773631 - protein, 56 aa, Homo sapiens
GAYYYYYYCSFKLLTMYGAMRIKKMNKHILFRKWMYKKIKCNKVCVQKLTQWKKKK

SEQ ID NO: 773632 - protein, 339 aa, Homo sapiens
STGSTQSAHYGRGAAAAKRAQAPAAALQMAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 773633 - protein, 339 aa, Homo sapiens; identical to SEQ ID NO: 773632

SEQ ID NO: 773634 - protein, 138 aa, Homo sapiens
MFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 773635 - protein, 138 aa, Homo sapiens; identical to SEQ ID NO: 773634

SEQ ID NO: 773636 - protein, 237 aa, Homo sapiens
STGSTQSAHYGRGAAAAKRAQAPAAALQMAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGACPRSTPFAWKHSLSFQPLIPLPPAYPRISAGEPELRRS

SEQ ID NO: 773637 - protein, 392 aa, Homo sapiens
STGSTQSAHYGRGAAAAKRAQAPAAALQMAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQYHNEDLEKDKTSQNCLGRGMEQVAKKLGVAHEEIQRLTDELQVKEKEQCKLDSALKKAQLEIDKLKENLVKLKENDAADLQKAKEQNQRLDEEILALRNRVRSLDSEKKVLGEMVERLKGEVCESQENKQLGNHSPGKTVGGEQREQIEASMLEPELSVT

SEQ ID NO: 773638 - protein, 105 aa, Homo sapiens
MKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 773639 - protein, 272 aa, Homo sapiens
STGSTQSAHYGRGAAAAKRAQAPAAALQMAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQGKVQLEDILHHLEKEEINPLATTEEQLCLVLIPASTVKTG

SEQ ID NO: 773640 - protein, 138 aa, Homo sapiens; identical to SEQ ID NO: 773634

SEQ ID NO: 773641 - protein, 339 aa, Homo sapiens; identical to SEQ ID NO: 773632

SEQ ID NO: 773642 - protein, 339 aa, Homo sapiens; identical to SEQ ID NO: 773632

SEQ ID NO: 773643 - protein, 241 aa, Homo sapiens
STGSTQSAHYGRGAAAAKRAQAPAAALQMAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQVMGASLPEI

SEQ ID NO: 773644 - protein, 195 aa, Homo sapiens
WPEFRHLIVPGFAEALRSYQEAAAAGTFLAVEFTTLADYLHLLQAAAQALNPLGPSAMFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 773645 - protein, 165 aa, Homo sapiens
MLELQYHNEDLEKDKTSQNCLGRGMEQVAKKLGVAHEEIQRLTDELQVKEKEQCKLDSALKKAQLEIDKLKENLVKLKENDAADLQKAKEQNQRLDEEILALRNRVRSLDSEKKVLGEMVERLKGEVCESQENKQLGNHSPGKTVGGEQREQIEASMLEPELSVT

SEQ ID NO: 773646 - protein, 123 aa, Homo sapiens
GRYSSGELLSSDPSVAITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 773647 - protein, 191 aa, Homo sapiens
STSGEAAVRWDAMEYDEKLARFRQAHLNPFNKQSGPRQHEQGPGEEVPDVTPEEALLELPPGEPEFRCPERVMDLGLSEDHFSRPVVCSWPLTSSSCGRRIEECKQVILELPEQSGEAEGCRGATHPPPAEAPGSWKDPNEDEAKTSECSLSTAFYKEKSKSVKETCDKCNTIIWGLIQTWYTCTGPRPDE

SEQ ID NO: 773648 - protein, 114 aa, Homo sapiens
FHWVQIPSTQSSPICPSMAEQSELTVSDPFPGPTPTSTGVPAVCTHGVALGWLWVALITWTAFSSFLVCPPLSCSSISVLHAAAASAPTVVPGSLWCSAHVVKFKLLNDWMSLT

SEQ ID NO: 773649 - protein, 173 aa, Homo sapiens
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 773650 - protein, 55 aa, Homo sapiens
MLEVLLHSQEQAMGSGTLVPGSLLLLYLDFHCRRQCLGNAITCPPSPLSSRQHRG

SEQ ID NO: 773651 - protein, 74 aa, Homo sapiens
PGSNNCPTSASRVAGTTGMSHHARLIFVFLVETGFPHVGQAGLELLASRDPPASASQNAGITGVSHRHRPRISL

SEQ ID NO: 773652 - protein, 68 aa, Homo sapiens
TQKEVMALEKVRVVPKIACSRWFPFCGRKAPCVGVCSLEGIAPLRCWSPSIGSNSGIPAVTRQSSPSR

SEQ ID NO: 773653 - protein, 118 aa, Homo sapiens
THIHHTHNHSSQTHTHTTLLTHVQAPQITRRCTHSTHTSIYCAGRKQMLEWCRTGARHLGSPMAAAELEPAPLRLQWLRVPGCERKSSTLSRRKGEGMQDRTRVLWEAHVCGTTPGLP

SEQ ID NO: 773654 - protein, 39 aa, Homo sapiens
MEALGQCWEKRAGFQQAAPPPLVKATEPSQRTTAQQGPL

SEQ ID NO: 773655 - protein, 179 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNLPSIGSCKNGGNNGHPGG

SEQ ID NO: 773656 - protein, 287 aa, Homo sapiens
YAVTRLELYCMYAFMNHSYISSELSDTKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWASQKTFPAGGSPIKKMLQAKNAARLIVPIRGQCCLPRCYRRCGHIRLAPGG

SEQ ID NO: 773657 - protein, 245 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHSPSL

SEQ ID NO: 773658 - protein, 303 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQ

SEQ ID NO: 773659 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFDAEY

SEQ ID NO: 773660 - protein, 316 aa, Homo sapiens; identical to SEQ ID NO: 773659

SEQ ID NO: 773661 - protein, 332 aa, Homo sapiens
YAVTRLELYCMYAFMNHSYISSELSDTKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFDAEY

SEQ ID NO: 773662 - protein, 983 aa, Homo sapiens
DPIAATAMRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKGNNKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 773663 - protein, 983 aa, Homo sapiens; identical to SEQ ID NO: 773662

SEQ ID NO: 773664 - protein, 138 aa, Homo sapiens
MGPFSLAALTFASLFLTSLPCIHPFLFFFFFVFLLAGAFYLYLLILFVASKWKEEFLSDLLLILHLPSLLYFPPPRERERERNADLTTAATAAATTAATTTLVMFTRPQINPEPGPCWSGGGYVNNPMSVPSSGPGVS

SEQ ID NO: 773665 - protein, 44 aa, Homo sapiens
NVEGLFVCHLLYYQMKTEKLHGHRDAVKEFDEIPYPRLENFFFF

SEQ ID NO: 773666 - protein, 51 aa, Homo sapiens
RLRHCTPAWATEQDCLTTEKEERKVTLFGLPGNGSQDSDSRASCLRGGEEN

SEQ ID NO: 773667 - protein, 102 aa, Homo sapiens
QLGHIFMPPSPSTTPPHPYQQGPPSYQKQGSHSVAYLPYTASSLSKGSMKKIEITVEPSQRPGTAINRSPSPISNQPSPWNQHSLYTPTGPSCTPSPSPRVI

SEQ ID NO: 773668 - protein, 911 aa, Homo sapiens
ERSEARSPIEMMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSRDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 773669 - protein, 178 aa, Homo sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHD

SEQ ID NO: 773670 - protein, 249 aa, Homo sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 773671 - protein, 280 aa, Homo sapiens
SSFFAATRTELGEIILLFFNFYFNFNGTCAGMEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 773672 - protein, 84 aa, Homo sapiens
MRFFLVPLIPEDPHIDESKAKHQAIIMSTSLRVSPSIHGYHFDTASRKAVGNIFENTDQGSLERLFRNSGDKKAEERAKIIFAI

SEQ ID NO: 773673 - protein, 124 aa, Homo sapiens
LADYSLYYGRQLMTICTMDYLVLNALSFVCYVGHSLTNLPLTLCFPDLISFPIIFHCLWNSQSCFPSLHRDYPFLNCSLPEFIPIHHRDVMHKRAVPFPGKEFFITETNSYPVFCLLRITVLYF

SEQ ID NO: 773674 - protein, 72 aa, Homo sapiens [sequence omitted]

SEQ ID NO: 773675 - protein, 37 aa, Homo sapiens
MENLRPEVQELLVEFNAVLQNGYPRILDLSLGPGSAT

SEQ ID NO: 773676 - protein, 35 aa, Homo sapiens
KQTALFERRRTAESPRPRGPGDIGLTCGKTSVLWR

SEQ ID NO: 773677 - protein, 93 aa, Homo sapiens
RGGDAGAGELGLRGTGRPRRGREPGSQSAALSPASTRTGGPFVLTRRTRITARCQGALIVCACHHALGGNPESYPQSRPFNHRLVPLSAPVKI

SEQ ID NO: 773678 - protein, 146 aa, Homo sapiens
GLGLSLRWVSCSLCSPAQRPPSQALGQLQEGHTGRSCCSCSLGQDIRGLGHQLPIVDLNLLHNYGPGEAGVAEGDGAHARAKAGAEAIAEAGACETLIGRAQTTCIATGGLHMDIHVLHPRLQLALLALQQLPVDGDLDVQGQPDV

SEQ ID NO: 773679 - protein, 112 aa, Homo sapiens
LTSQSEAVVVRAMKDKLGADHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 773680 - protein, 684 aa, Homo sapiens
CLKNSNSSIQSAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKDHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 773681 - protein, 62 aa, Homo sapiens
SQQTDTNRAGTLGKRARIHFKKQTNKKTQNFILLYNAEYFKGGKNGNREIVMRLLQEFSLEL

SEQ ID NO: 773682 - protein, 121 aa, Homo sapiens [sequence omitted]

SEQ ID NO: 773683 - protein, 1019 aa, Homo sapiens
MALFVKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKEPVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLFLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPPDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEAA

SEQ ID NO: 773684 - protein, 1723 aa, Homo sapiens
KDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKDHLNIGEWRGGIYGQQLFGNVPVLRLLLVNQYWWMLPSCLLVAIVCLVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKEPVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLFLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPPDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEAA

SEQ ID NO: 773685 - protein, 671 aa, Homo sapiens
KDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVAFYVFLI

SEQ ID NO: 773686 - protein, 1676 aa, Homo sapiens
KDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKEPVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLFLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPPDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEAA

SEQ ID NO: 773687 - protein, 671 aa, Homo sapiens; identical to SEQ ID NO: 773685

SEQ ID NO: 773688 - protein, 671 aa, Homo sapiens; identical to SEQ ID NO: 773685

SEQ ID NO: 773689 - protein, 634 aa, Homo sapiens
KDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGKMLFLYYYYLLLFSQMTPQS

SEQ ID NO: 773690 - protein, 44 aa, Homo sapiens
MQQMIGQTRSQLSVRVLVGEMGVTQPHQAVQAVTGRRGKLGKKV

SEQ ID NO: 773691 - protein, 68 aa, Homo sapiens
SHTQLLTVWYVGIFCPTAACAFAEHLQESHVGDGLDVAGTRAELLRFSECGQTRCSDMALGGVGTQAG

SEQ ID NO: 773692 - protein, 207 aa, Homo sapiens
RGVGLPFSLAWCLMSRLRSCLFVLVLERGWSPFFTCVVSDEPSVVVCVCSSAASRIFSLSAFEQLDYDGPWYGFLCVPCACSSLRFLDLGLCSFHEICIILKLHICRCFFCPSTPQDLRHAGIRHAGIRQVGIRHAVIRHAGIRHVGLRHTGITWVSGTQLSGTRVSGRRVSARGCRAGGCRARGCRAGGRRAGGRQAAWLCPTAAQ

SEQ ID NO: 773693 - protein, 488 aa, Homo sapiens
ALRSSAVVELDLEGTRIRRKKPLGERPKDEDERTVYVELLPKNVNHSWIERVFGKCGNVVYKVYHYKSTGDPKGFAFVEFETKEQAAKAIEFLNNPPEEAPRKPGIFPKTVKNKPIPALRVVEEKKKKKKKKGMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 773694 - protein, 246 aa, Homo sapiens
ALRSSAVVELDLEGTRIRRKKPLGERPKDEDERTVYVELLPKNVNHSWIERVFGKCGNVVYKVYHYKSTGDPKGFAFVEFETKEQAAKAIEFLNNPPEEAPRKPGIFPKTVKNKPIPALRVVEEKKKKKKKKGMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRVTFHSPMS

SEQ ID NO: 773695 - protein, 267 aa, Homo sapiens
MRQPLGQKPASGLVNQKDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 773696 - protein, 214 aa, Homo sapiens
MGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 773697 - protein, 505 aa, Homo sapiens
ALRSSAVVELDLEGTRIRRKKPLGERPKDEDERTVYVELLPKNVNHSWIERVFGKCGNVVYKVYHYKSTGDPKGFAFVEFETKEQAAKAIEFLNNPPEEAPRKPGIFPKTVKNKPIPALRVVEEKKKKKKKKGMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRVHFTAPCLNGELFYLFQDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 773698 - protein, 269 aa, Homo sapiens
RRKCPKPQYLTLYFGSRTEKETESGNQEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 773699 - protein, 166 aa, Homo sapiens
EPISHRYWVLRDATVCTLWSMGPVTRNGKYLPSTLPRNQIFIKCVCCQVLFLFPRHTCSFSYVLPVHLIWFGPVSPSYLILNYNAHLLREGPVIQVIGLWEWFPHAVLVKPDGFINGSFSCAHTVSLSCCLVKKVSASPLPSAMIVSFLRPPQSCGTVSQLNLFPL

SEQ ID NO: 773700 - protein, 87 aa, Homo sapiens
MVQGRKVCRARRGSDFAFPVPTEPGRKVCRVRRGLGLCISSGHGAGPEGVQSPERLRLCISGVGQSRAGRCAEPGEVSDFAFLVHMV

SEQ ID NO: 773701 - protein, 110 aa, Homo sapiens
MRRDPIAPLPQLPVIPVLGKQPWKHRLAGSTCLGCQTRAQLLHCLCGPRRPSHPRPPAPWLGSPGSCEQLQRVQLSQLPSVLGGKIQSCVFRQNRRLMAQGRGGQSRLCS

SEQ ID NO: 773702 - protein, 246 aa, Homo sapiens
MMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGLTSPYYMDYVHLDFLPGVCYSSLQIMMCQIQAVKARLQNQYIQDKLYKLDVEEERKQNFIFPNQGPKKLGDIVLFNGIMWLAPTWVLQVRTPPGPGRFQGTVFEGG

SEQ ID NO: 773703 - protein, 106 aa, Homo sapiens
MNISQIISYWGYPDEEYDIVTEDGYILGLYRIPYWRTDNNKNLAQRVVVYLQHGLLTSASSWISNLPNNSLGFILADAGYDVWMGNSRGNTWSRKHLYLETSSKEF

SEQ ID NO: 773704 - protein, 258 aa, Homo sapiens
RVGVSCAWCVGGVSGCVLVSGGKRCRVWEVPVAVVWAARCLLPRLLYAVPFGSDAGTYCGSRRVLPRPGRGGGGSAQAPTAPLPEELRREDAGSAMRDEPQSALGRPAARSRGADKPAAGGCEAAVPVAAAPYRSALRFPRTRLGVRARVRAILPRRPGTEGPGKGGGRLRRGRGGIPPRDNHGRHVREAPAGSGGGPSFGPRAGGEGGPRVALGTPGTAAARTPWSPAAGPRCAFLLCSLPGMRNLEPRCRVTELSW

SEQ ID NO: 773705 - protein, 258 aa, Homo sapiens; identical to SEQ ID NO: 773704

SEQ ID NO: 773706 - protein, 305 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEGLRGSPPGPQELDVWLLGTVRALQESMQEVQARVQSLESMPRPPEQRPQPRPSARPWPLGLPGPALLFFLLWPFVVQWLFRMFRTQKR

SEQ ID NO: 773707 - protein, 128 aa, Homo sapiens
PPPPSRGVFFPSDPPQSWRSVVVHVPGAGLAVTRGRGDRVSAPAFPSLWVTRIFPPLLLPEEVELLSKLGLGPGPGRMIGWEAAGGRPGGPDQLGGVSRPRGRGMSAVCSLSSPAGPLRPHTHSGRLH

SEQ ID NO: 773708 - protein, 84 aa, Homo sapiens
PSICVAIPALLDPGVSRKPRGGGERGPRCPGSGRRGAHAGPRCRRPGWETVRPALSTPILFLHLFGSWRCAPKGGASGDGHIWH

SEQ ID NO: 773709 - protein, 341 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPASLWAVTLPTPPQSPIHPGTWTPRFSVIPWSSWSLSWFGQSSGQHLEESVIPGTAPCPPQRKRGCGAARRGPRSWTCGCWGQFEHYRRACRRCRRGCRAWRACPGPLSRGRSPGPVLGHGPLGSRGPRCSSSSCGPSSSSGSSECFGPKRGDCQWRGLCSQLRLSCCALSLPRV

SEQ ID NO: 773710 - protein, 269 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEAAAQAQCSAMAPWAPGARAALLPPVALRRPVALPNVSDPKEVTVSGGVSAAN

SEQ ID NO: 773711 - protein, 323 aa, Homo sapiens [sequence omitted]

SEQ ID NO: 773712 - protein, 365 aa, Homo sapiens
MGTEKESPEPDCQKQFQAAVSVIQNLPKNGSYRPSYEEMLRFYSYYKQATMGPCLVPRPGFWDPIGRYKCVSSLLAGQTSLSCQAALSQPSAPRDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPASLWAVTLPTPPQSPIHPGTWTPRFSVIPWSSWSLSWFGQSSGQHLEESVIPGTAPCPPQRKRGCGAARRGPRSWTCGCWGQFEHYRRACRRCRRGCRAWRACPGPLSRGRSPGPVLGHGPLGSRGPRCSSSSCGPSSSSGSSECFGPKRGDCQWRGLCSQLRLSCCALSLPRV

SEQ ID NO: 773713 - protein, 341 aa, Homo sapiens; identical to SEQ ID NO: 773709

SEQ ID NO: 773714 - protein, 196 aa, Homo sapiens
MRILGREAQRLPAKVTWLERAGCEWRCWGCFRASLPPQGTGTPKPSFPLGSNSTNPSTESHSPRDLDSEVFCDSLEQLEPELVWTEQRAASGGKRDPRNSPVPPTKKEGLRGSPPGPQELDVWLLGTVRALQESMQEVQARVQSLESMPRPPEQRPQPRPSARPWPLGLPGPALLFFLLWPFVVQWLFRMFRTQKR

SEQ ID NO: 773715 - protein, 151 aa, Homo sapiens [sequence omitted]

SEQ ID NO: 773716 - protein, 238 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKAAQPQEVIHILWTPPFGNLRRQ

SEQ ID NO: 773717 - protein, 312 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEGLRGSPPGPQELDVWLLGTVRALQESMQEVQARVQSLESMPRPPEQSHSVGQTGVKWRELGSLQPPPPRVQAILCLSLPSSWDCRRPPPCPANFF

SEQ ID NO: 773718 - protein, 54 aa, Homo sapiens
LPVLLFLDLFQALTFHITHGTSSVRLPESRNQVKYKSTVLPAGGMGIIGQYNSP

SEQ ID NO: 773719 - protein, 101 aa, Homo sapiens
GCSLGSLQPQPTMLSQASHLSHLSSLGHMLMPPLLANFFIFCRDMGSCCVAQAGLEFLDSSSFLVSASQSGGITGVSHRNLTCNFLVMLLSPFGVRFILAS

SEQ ID NO: 773720 - protein, 162 aa, Homo sapiens
IKTPAERLRGPLPPSADDNLKTPSERQLTPLPPSAPPSADDNIKTPAERLRGPLPPSADDNLKTPSERQLTPLPPSAPPSADDNIKTPAERLRGASVGSASTPQRMIISRHLRKTVSSLPFTPISIHAVSQSDKYQDTCTSVCGGRFHPQPMIISRHLPNVS

SEQ ID NO: 773721 - protein, 177 aa, Homo sapiens
VKPFTPSEQVRRPCSLGAVPTLSPYPFLDHATHVTTPDFPAVFQSLFPGSLLPRTLVCVPLGPRGGQGASVCECDFALRSWCDPWAEREALWCRTETKAVYSFPISAVKKLPQTYYLTFMEARGPKWVSLGYNQGIAMAVSFLRLQGESVCLPFPASRGHLCSLAGGHLQSQQSHHS

SEQ ID NO: 773722 - protein, 67 aa, Homo sapiens
SEHDLRIVLVKSSVQCQDALGLYRWLCFPCTSLAWSHTKEENREVESLCSLLVFKKPGSWKDIWELH

SEQ ID NO: 773723 - protein, 116 aa, Homo sapiens [sequence omitted]

SEQ ID NO: 773724 - protein, 299 aa, Homo sapiens
SRDWEETAAGRGLRGTMGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEERLAGATLLIFANKQDLPGALSSNAIREALELDSIRRHHMVHPGLQRRHRGEPAAGPSTGSWMTFPAAFSQLTEPFQMRPASSPGPSTSQTYPWGLRVSGKYTSHYSTQLVLYCGQCCLEQPGSIGEGWLVVSGRLPGSQPQKGGGREDRAEGGHHPVNGGQKEKKCGGEN

SEQ ID NO: 773725 - protein, 214 aa, Homo sapiens
SRDWEETAAGRGLRGTMGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEERLAGATLLIFANKQDLPGALSSNAIREALELDSIRRHHMVHPGLQRRHRGEPAAGPSTGSWMTFPAGQTNAPPPPPQPAAATAAR

SEQ ID NO: 773726 - protein, 413 aa, Homo sapiens
LHLLTLAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIARLVCLWPCHNGGTCFHYIGKYKCDCPPGFSGRHCEIAPPPASGARVVNGGTCEDRDTDFFCHCQAGYMGRRCQAEVDCGPPEEVKHATLRFNGTRLGAVALYACDRGYSLSAPSRIRVCQPHGVWSEPPQCLGDSVG

SEQ ID NO: 773727 - protein, 254 aa, Homo sapiens
MQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVPIEPIIAACVVIFLTLCFGLIARRKKIMKLCMKDKDPHSETAL

SEQ ID NO: 773728 - protein, 116 aa, Homo sapiens
WPKPITKALKAASCDVEAPFLSGAGISRSDYLGHWVLCQQVPAFRTTGSSEGIFEPLSNLASFSLQVTPSLKELILWKTWKVQWLQLLLLKSVARPGAVAHAYNPNTLGGRGRRIT

SEQ ID NO: 773729 - protein, 359 aa, Homo sapiens
SGDLNAPLALGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKVQIHPSLSGLDVLLGFWSPTLQRGRLCT

SEQ ID NO: 773730 - protein, 915 aa, Homo sapiens
SGDLNAPLALGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPYHFVCRGKVSVKGKGEMLTYFLEGRTDGNGSQIRSLGLDRKMCPFGRAGLQGRRPPVCPMPGVSVRAGLPPHSPGQYLPSAAAGKEA

SEQ ID NO: 773731 - protein, 625 aa, Homo sapiens
SGDLNAPLALGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQARRALSAFWGW

SEQ ID NO: 773732 - protein, 256 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPPISSPLATSGTIFSAISCFWDLPAPFLWLAPSCQPTMSSQIRQNYSTDVEAAVNSLVNLYLQASYTYLSLGFYFDRDDVALEGVSHFFRELAEEKREGYERLLKMQNQR

SEQ ID NO: 773733 - protein, 911 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 773734 - protein, 906 aa, Homo sapiens
MDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGQCQYLSPYLLPLTLWPLSQPQLLTLSDPPDPCISLTMTLLYGLLGNDLLTLIPLGPLPTGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 773735 - protein, 975 aa, Homo sapiens
RGTKERRGTKERRGTKEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGQCQYLSPYLLPLTLWPLSQPQLLTLSDPPDPCISLTMTLLYGLLGNDLLTLIPLGPLPTGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 773736 - protein, 596 aa, Homo sapiens
MDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGQCQYLSPYLLPLTLWPLSQPQLLTLSDPPDPCISLTMTLLYGLLGNDLLTLIPLGPLPTGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKVGAYGDVNAHGRLCIRLRQWPGARAQACNLRTLGGRGRWITRDQEFKTSLTNIVKLHLY

SEQ ID NO: 773737 - protein, 911 aa, Homo sapiens; identical to SEQ ID NO: 773733

SEQ ID NO: 773738 - protein, 1031 aa, Homo sapiens
MLGAQITVDNWTLRTTPWRSCSAGGCSLASAVLPPGGSGDLVLDSYLRWGWKSPSQPSLSGHFPQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGQCQYLSPYLLPLTLWPLSQPQLLTLSDPPDPCISLTMTLLYGLLGNDLLTLIPLGPLPTGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 773739 - protein, 906 aa, Homo sapiens; identical to SEQ ID NO: 773734

SEQ ID NO: 773740 - protein, 508 aa, Homo sapiens
SQKVQRYMICQFEVHLRTLRSYEKLTRYSFASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 773741 - protein, 922 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 773742 - protein, 684 aa, Homo sapiens
MNSVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 773743 - protein, 407 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRADGSKMRAVFSHQYLIY

SEQ ID NO: 773744 - protein, 989 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVRSHRTLKADGCIDGGRGDWVGTGIYTGSSRRWRNYEQQQKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 773745 - protein, 576 aa, Homo sapiens
TPHRGSKQWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 773746 - protein, 125 aa, Homo sapiens
MHVSDPHSLHTVRLACLVGRQQCPWMYPGALCCRDVILNNKPSRGWERFHGNLNFKTKISLVTVVAENTGSCHVQWLSTPGGQPAVAIPWSPTGPPRHFTSRRLPCTRPPFHGSQALPHLPVLPT

SEQ ID NO: 773747 - protein, 55 aa, Homo sapiens
SSPSQKPKGGVSWFWEDELEETLWVEKKQVERGYVFECLLCAGPGEKVLIWMHRL

SEQ ID NO: 773748 - protein, 407 aa, Homo sapiens
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQGKFF

SEQ ID NO: 773749 - protein, 301 aa, Homo sapiens
KASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYCFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVK

SEQ ID NO: 773750 - protein, 62 aa, Homo sapiens
TKNKGETRIKFLTCVIGKCAGLTSCFVYEAVGYKDSHTSLWNAEHCNLMEEDLAASNKSMWH

SEQ ID NO: 773751 - protein, 122 aa, Homo sapiens
MSFSAHDLWPPPNLCAPTSASITRFQPQILVPGIKAKTCSFPRSLLGSLSLCSTLSTNIRVAFSLSPISVNLCPIPLLYLPHNFYHCLKFSCLCLYVLYILSHSCASSGRDHSSICVRAEPN

SEQ ID NO: 773752 - protein, 34 aa, Homo sapiens
MLPGALRALLLTEGYRSELGVQNFSPRPVWKDQE

SEQ ID NO: 773753 - protein, 164 aa, Homo sapiens
RGPRLWSCLPCAVVWQPWSVPFLGAGPTLCQVPLPRISCATWLWHWQLCGSGQSEQQQLFPVPWRGQDWDSRGSTLMALSLISGRGKRKLGKSNMTLGARPPTMPPCSQASPAGLQELDLPSQHGSVLPLPLTVLQRAGRAISCHLSLIAIWPPDLPEVQWGGQ

SEQ ID NO: 773754 - protein, 168 aa, Homo sapiens
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSY

SEQ ID NO: 773755 - protein, 171 aa, Homo sapiens
MHETDSLQGSAAAFWMHKAHHRDEENVLEQCISPGARGHPVLDEAAGPHTAGVVPQCWELPALGGIWPRVPASGWGCAEGLRKLGVLPGWAPPGPPRGPPLGLQLAIYEKLDRARWRHVGAGPELPGTRRGRVSGTLTWQHEEASVDSRSRVYGQSGRSACVNACRTGARS

SEQ ID NO: 773756 - protein, 152 aa, Homo sapiens [sequence omitted]

SEQ ID NO: 773757 - protein, 136 aa, Homo sapiens
SRNCPWRHHAGPINRPVGPGGAAPQDWGRGQLRGPQKRSCRRSGGARRPECQGWWVPEITRTPPPGGLAQAWGRCPPGSDLLPRARGFQAPAPPSSSESRGRAGWRVARVGSADPFERGSNSPSLWCYAARGCPCG

SEQ ID NO: 773758 - protein, 103 aa, Homo sapiens
GLQDRKVPSHSLGGPKSEVKLSAGPHPLWMLQGRVLCLFQFWWLQAFLALWWHHSSLLRLHVAFSVLSNLLLCSLVKTLVIGFRAHPNLDGLILSLTLVTSAK

SEQ ID NO: 773759 - protein, 50 aa, Homo sapiens
TTGQRKPADTLVLDCTLQDCKKIHLCYLSFTQPVVLCYGSPRILTSYKAY

SEQ ID NO: 773760 - protein, 407 aa, Homo sapiens
MSHRKFSAPRHGHLGFLPHKRSHRHRGKVKTWPRDDPSQPVHLTAFLGYKAGMTHTLREVHRPGLKISKREEVEAVTIVETPPLVVVGVVGYVATPRGLRSFKTIFAEHLSDECRRRFYKDWHKSKKKAFTKACKRWRDTDGKKQLQKDFAAMKKYCKVIRVIVHTQMKLLPFRQKKAHIMEIQLNGGTVAEKVAWAQARLEKQVPVHSVFSQSEVIDVIAVTKGRGVKGVTSRWHTKKLPRKTHKGLRKVACIGAWHPARVGCSIARAGQKGYHHRTELNKKIFRIGRGPHMEDGKLVKNNASTSYDVTAKSITPLGGFPHYGEVNNDFVMLKGCIAGTKKRVITLRKSLLVHHSRQAVENIELKFIDTTSKFGHGRFQTAQEKRAFMGPQKKHLEKETPETSGDL

SEQ ID NO: 773761 - protein, 68 aa, Homo sapiens
RIGRGPHMEDGKLVKNNASTSYDVTAKSITPLVRLGGGDCQAHHTADDGWSGVRLAGGPGIHVGGMPQ

SEQ ID NO: 773762 - protein, 39 aa, Homo sapiens
GLGKRPTGVIRIFICPHQLPNGSSSASLQESRPFSRTAL

SEQ ID NO: 773763 - protein, 45 aa, Homo sapiens
TRIPAQDVTVHCPVPHLHPPGVSVDLLPTSILLVCLDLLPTSILV

SEQ ID NO: 773764 - protein, 165 aa, Homo sapiens
AAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKSPLCPSVSSCESWDLFRSALPAVLGSTATTFDSRSFLQAGAAIFPK

SEQ ID NO: 773765 - protein, 166 aa, Homo sapiens
AAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPT

SEQ ID NO: 773766 - protein, 703 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 773767 - protein, 683 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 773768 - protein, 658 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKAPGDLPAAGGPPSGAMPFYNPAQLAQACATSGSSRLGRIGQRKHLVLN

SEQ ID NO: 773769 - protein, 678 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKLSRCSSMSSLSREVSQHFNQAPGDLPAAGGPPSGAMPFYNPAQLAQACATSGSSRLGRIGQRKHLVLN

SEQ ID NO: 773770 - protein, 632 aa, Homo sapiens
MGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 773771 - protein, 580 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVQ

SEQ ID NO: 773772 - protein, 838 aa, Homo sapiens
SLFTAPVMTRFANSLPINDPLQTVYQLMSGRMPAASTCCGDEKWGDWRPHLAMVLSNLNNNMDVESRTMATMGDTLGRSGVEMGIGCRGWSAEGPVVCGVGRNHQNPAFSVRLASLVPSVRVLDFCKRSRSLSPRRVSCRLSAASRGLLDAAHFCYLMAQAGFGVYTKKTTKLVLIGSNHRKEPSQCSPVSFPFKVKQNPSPLVNSEMARIMSLFVTWWDTLLDDFAPRLTMPIIGHFFQIKIIHFLYSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 773773 - protein, 725 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQHALLQPCSAGTGLRHLRELKAREDWPEEAPGAELGLPCCELALGALTLLFSPKNPTDLRDLRPAPRETQQ

SEQ ID NO: 773774 - protein, 653 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 773775 - protein, 343 aa, Homo sapiens
RSRLVRVRVRSSILLVSLWICSHLHPPGVSVDRPPPPSSWCLCGSPPTSILLVSLWICSPPPSSWCLCGSAPTSILLVSLWIWRLWGLTEGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 773776 - protein, 703 aa, Homo sapiens; identical to SEQ ID NO: 773766

SEQ ID NO: 773777 - protein, 703 aa, Homo sapiens; identical to SEQ ID NO: 773766

SEQ ID NO: 773778 - protein, 703 aa, Homo sapiens; identical to SEQ ID NO: 773766

SEQ ID NO: 773779 - protein, 645 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVSGYGGKGERYPVRRHLPILPDRALPSASQYPMCT

SEQ ID NO: 773780 - protein, 200 aa, Homo sapiens
SLFTAPVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQMASQLRLFDPQLKEKPEEESLAAPTWLVHLQQVERQIKEGAGLCISGDTPR

SEQ ID NO: 773781 - protein, 107 aa, Homo sapiens
PDLHSPGVSGSAPHLHPPGVSVDLLPTSILLVCLDLLPTSILVSLWICSPPPSSWRLCGSAPTSILLVSLWICPPPPSSWCLCGSAPTSILLVSLWIAPHLHPPGVS

SEQ ID NO: 773782 - protein, 703 aa, Homo sapiens; identical to SEQ ID NO: 773766

SEQ ID NO: 773783 - protein, 703 aa, Homo sapiens; identical to SEQ ID NO: 773766

SEQ ID NO: 773784 - protein, 703 aa, Homo sapiens; identical to SEQ ID NO: 773766

SEQ ID NO: 773785 - protein, 69 aa, Homo sapiens
MPAASTVSGTAWWLAQAPLPVWSLLVGDAVTGREVPGEPSCVELKWRWLPGMRLRFVFPHVSAVETRNG

SEQ ID NO: 773786 - protein, 74 aa, Homo sapiens
CAHEVGRCSALVSADHAGVAVAGWEGGVPVDLCATHTSRLLVTEIIVALFPVDRDSAAGGACWKLTFRAKRRKF

SEQ ID NO: 773787 - protein, 30 aa, Homo sapiens
MPFYNPAQLAQVSDSYLSLRDPNTPTDDLT

SEQ ID NO: 773788 - protein, 84 aa, Homo sapiens
MAKPGTSRPSSAPLPGCDLGTLYRAPLPKAERVRRSQGGSLHGGIRPASLPELKARRFCKEEQSGAGYKQLMKIIVLAHTALRP

SEQ ID NO: 773789 - protein, 105 aa, Homo sapiens
PLSRTSNKELRHLIEVSVVLWAVALTSWISDRLLCSFWQRIHFFYLHSIWHVLISITFPYGMVTMALVDANYEMPGETLKVRYWPRDSWPVGLPYVEIRGDDKDC

SEQ ID NO: 773790 - protein, 209 aa, Homo sapiens
GVRCEAAVRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 773791 - protein, 209 aa, Homo sapiens; identical to SEQ ID NO: 773790

SEQ ID NO: 773792 - protein, 463 aa, Homo sapiens
GVRCEAAVRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 773793 - protein, 388 aa, Homo sapiens
TWTRTGGVLKVTTKEGGGSQATDVPDAVLGSVCALAWLPCVPCADSGIPGNVESRIFMRKQDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 773794 - protein, 446 aa, Homo sapiens
GVRCEAAVRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 773795 - protein, 189 aa, Homo sapiens
RYLPVVHTPLDSRGNLQLWVRGHLALVFALYRSCGPRGASGEDVSGRGFPAFCLGQWGCSCLSFSPTPWTVLGCWCTWLAHGGQRAENATAWLLVPFDQETQEETPQSAERPPGSLAHSRSGRDGRVSSLSSGIRKGMVSTPHCGGFRQGSYCLLCLGFPIWKMGAGVLTYLRWNGEQGTCRSPSENVM

SEQ ID NO: 773796 - protein, 67 aa, Homo sapiens
GVRGVTRPCLAGFSLQHALPGADGVSARTQAPGDQPSAVQLRGGAGGDSREAGAMEVGGGGAVSGGP

SEQ ID NO: 773797 - protein, 245 aa, Homo sapiens
RGRSRETDARRRSGAEPTARLPWPAALEEWPSCPCEPLGPGRRCRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 773798 - protein, 245 aa, Homo sapiens; identical to SEQ ID NO: 773797

SEQ ID NO: 773799 - protein, 134 aa, Homo sapiens
TWTRTGGVLKVTTKEGGGSQATDVPDAVLGSVCALAWLPCVPCADSGIPGNVESRIFMRKQDPNEDEPNIRVLLEHRFYKEKSKSVKQTCDKCNTIIWGLIQTWYTCTGGPRPRRGVRNERDQSSCLRWAHIQM

SEQ ID NO: 773800 - protein, 499 aa, Homo sapiens
RGRSRETDARRRSGAEPTARLPWPAALEEWPSCPCEPLGPGRRCRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 773801 - protein, 399 aa, Homo sapiens
MGLNRELLQDGPLTAPAPNLGKGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 773802 - protein, 497 aa, Homo sapiens
GVRCEAAVRWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQDLLDVHAGRLGCSLTEIHTLFAKHIKLDCEVGLCPGPLFSNPSPEGGLAGEAAQPSVSLASECPEELALTCPCPNPTLFPPRCQAKGFVCELCREGDVLFPFDSHTSVCADCSAVFHRDCYYDNSTTCPKCARLSLRKQSLFQEPGPDVEA

SEQ ID NO: 773803 - protein, 118 aa, Homo sapiens
DAWGDSVLEFPVQRAPTSFCPQGLLLRQLHHLSQVCPAQPEEAVALPGARSRCGGLAPRNSAGHPAWPARTHPANIKLFLLLRRPLGCGPGPLHPCWARAGGQCQGPLSPRCLLGLGA

SEQ ID NO: 773804 - protein, 586 aa, Homo sapiens
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRGFGALAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 773805 - protein, 586 aa, Homo sapiens; identical to SEQ ID NO: 773804

SEQ ID NO: 773806 - protein, 92 aa, Homo sapiens
LQHPYMSPYSCPEDEPTSQHPFRIEDEIDDIVLMAANQSQLSNWDTCSSRCSQPWVPEPTFPCPPISILPLILRDLPLCLPSCIAHWTTSPA

SEQ ID NO: 773807 - protein, 586 aa, Homo sapiens; identical to SEQ ID NO: 773804

SEQ ID NO: 773808 - protein, 586 aa, Homo sapiens; identical to SEQ ID NO: 773804

SEQ ID NO: 773809 - protein, 177 aa, Homo sapiens
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDGVSCWSESHQAGAQWCDLGSLQPPPPRFKRFACFSLLSSRDYRRVPPRPANFVFLVETGFHHVGQDGLRLLTS

SEQ ID NO: 773810 - protein, 104 aa, Homo sapiens
PLPDDESWECGWGCGSPAVALLLAAGYRVLREIPRYSPRTEATTGLARGLAWERGAGPDRTVSLPVYYKKSQVKHWKRCQKIQKRKTIQTEQSVMKMNRMRICS

SEQ ID NO: 773811 - protein, 115 aa, Homo sapiens
MEFRPVGFSKCGVVMPRQKLQFLRTEGVIYETVGSVALAVICHRAGLNLYVVHAPKHASCREGRKLIDLKLSSPLVSQERWELDKKFRLFPGLDITHMGRYLHRMVMVITNTTFW

SEQ ID NO: 773812 - protein, 115 aa, Homo sapiens; identical to SEQ ID NO: 773811

SEQ ID NO: 773813 - protein, 76 aa, Homo sapiens
FYKHFPDPIAKFPVRVCQWDTLKEPLKIGETSFLFSSCHMISAADIWLLLASSALNISFATLLRDICSSLTTHLAV

SEQ ID NO: 773814 - protein, 124 aa, Homo sapiens
RRARPARPCTPRAAPRGPAALAGRAALPPLSRGFYGPPAPQQPWGARGGPASGRERRGGGAECGGMRSRARPCRIPRPPARARPRPALPGLHALLPRPRIHLTLLGAPAGGGPGWVRGNSPAAQ

SEQ ID NO: 773815 - protein, 1222 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKKRQPEFSPTANVRRHMCSFENPHTAVNVSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPPHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 773816 - protein, 1194 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPPHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 773817 - protein, 189 aa, Homo sapiens
QWRNLDSLQPLPFRFKQFFCLSLLSSWDYRHVPPRLANFYILVEMGFHHVGQASLELLTSSDTPALAFQSARMTGVSCCTWPYLFIFDVESRSATQARVQWCNLDLGSQQSPPPGLQQSSHLSLPSSWVYSCAPPHLANFCIFAETGSHQIAQVGLELLGSRDLPASVSQNAGITGVSHRASPLGGFSG

SEQ ID NO: 773818 - protein, 315 aa, Homo sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRCLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCGKFGTNWDPDPKVSAGFTLQNMSPEDSHGRLMFFCM

SEQ ID NO: 773819 - protein, 320 aa, Homo sapiens
MPKKKTGARKKAENRREREKQLRASRSTIDLAKHPCNASMVSDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMSTRSLKFGRQTGGEEGDGASGYDAYWKNLSSDKYGDTSYHDEEEDEYEAEDDEEEEDEGRKDSDTESSDLFTNLNLGRTYASGYAHYEEQEN

SEQ ID NO: 773820 - protein, 53 aa, Homo sapiens
MGTDMCKGCPKRTGQDKRGFPRYKRPGDTGFENPRDRSLGLPQVQERIIARGE

SEQ ID NO: 773821 - protein, 147 aa, Homo sapiens
AVQSSQALVSTHVSCLRACFCDDHTRSKVFKQEKGKQPPCPKCGHETQETKDLSMSTRSLKFGRQTGGEEGDGASGYDAYWKNLSSDKYGDTSYHDEEEDEYEAEDDEEEEDEGRKDSDTESSDLFTNLNLGRTYASGYAHYEEQEN

SEQ ID NO: 773822 - protein, 320 aa, Homo sapiens; identical to SEQ ID NO: 773819

SEQ ID NO: 773823 - protein, 154 aa, Homo sapiens
MPKKKTGARKKAENRREREKQLRASRSTIDLAKHPCNASMVSDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHETHLNVSASITWQLA

SEQ ID NO: 773824 - protein, 68 aa, Homo sapiens
LKPGPHETLTLHPWHQRSSHFFSMNGPPEGPPVHGACSVCSLRTAWCTYRSALQAPRAAAPVRIPFHC

SEQ ID NO: 773825 - protein, 104 aa, Homo sapiens
RASQRVSQGSNPGFPPQPRPFHTPCSDFLPCPEETPCLRFGPLMRSCLTSWLSRTQGSPLGTLHSARGQRIEQEESSRRGLFDHPQPRQGQLDPVIILLLYLGH

SEQ ID NO: 773826 - protein, 97 aa, Homo sapiens
LWPVGKPRSRGSPSQGCDTFFGTAQFLVSPSFRVPPCSPRTFLDVLLRNVAAVLLLHPDMGPEMGACSRSHVWYIWSSHRLTWSWHLCQCPELSILS

SEQ ID NO: 773827 - protein, 139 aa, Homo sapiens
ALSRGKHFLPSTMKASRAETRWKLLVPPEDCYGLCFSVSQDAQAAMRPFDPSALLPTCWDYWTYVGSLTTPPLTESVTWIIQKEPVEVAPSQLSAFRTLLFSALGEEEKMMVNNYRPLQPLMNRKVWASFQATNEGTRS

SEQ ID NO: 773828 - protein, 130 aa, Homo sapiens
ETRREEAESEALLMTTPRSPGPGPFLGAGKSMAARAECPCLLSPVPETSAYSTHLLTLKDMTYRELLCPHTGQGLPVTASTSPASSLCYIYIFFFPFETGSHSFVQPGSAVVQMWLNCSLDLQVSSDPPE

SEQ ID NO: 773829 - protein, 126 aa, Homo sapiens
MVNILMANTKFDAFLKQSLPSYDLQKVMAAIKQQGIEDNDELPSAKGRKVLRSLVVCENGLPIKEGLSCNGPRLVGLRSTLQGRGEMVEQLRELTRLLEAKDFRSRMEGVGQLLELCKAKTELVTA

SEQ ID NO: 773830 - protein, 112 aa, Homo sapiens
SYQSEVGSIIVPISQMGKLRHREHRSLPQGHTASRWQSYVQTQLSWAQSLLPTHSTLWLCCTHRSRGALVSGISGCMFVHASGFTGGHHTQQGALSMARATLAQCSYLPQIS

SEQ ID NO: 773831 - protein, 226 aa, Homo sapiens
MLKNGTFVIRLRIISLIFLEKKISNFTDKNMKEVKKSPKQLAAYINRTVGQTVKSPDKLRKVIYAERKFIIPFQIFVTEKNSPLEGGGCDMANKENELACAGHQTEKLHHDSRTYLVNSSDSGSSQTESPSSKYSGFFSEVSQDHETMVQVLFSRNMRLNVALSFWRRRSISELVAYLLRIEDLGVVVDCLPVLTNCLQEEKQYISLGCCVDLLLLVKSLLKSKFE

SEQ ID NO: 773832 - protein, 221 aa, Homo sapiens
MSPLSAARAALRVYAVGAAVILAQLLRRCRGGFLEPVFPPRPDGVAIVTGGTDGIGYSTAKHLARLGMHVIIRDVSLAVLPGLALPLELKRSSHLSLSRSWDYRRAPSFPPKIWNFYYCDLASMTSIRQFVQKFKMKKIPLHVLINNAGVMMVPQRKTRDGFEEHFGLNYLGHFMLTNLLLDTLKESGSPGHSARVVTVSSGTHYVAELNMDDLQSSACYS

SEQ ID NO: 773833 - protein, 396 aa, Homo sapiens
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 773834 - protein, 119 aa, Homo sapiens
METYLDRTRWGLRGANFRGQLRFPPRPLLLFLHLTLFPLALSAVSPGPSSALCPLLWAIPQSPLPLEPLTQNLGPRGPSLPQLTSSGPGEPTQIPLPHLCSVPSIYAQLSPTLSNPVSF

SEQ ID NO: 773835 - protein, 471 aa, Homo sapiens
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLSIMCAHSNERYYGYTGAFRCLAENAGDVAFVKDVTVLQNTDGNNNEAWAKDLKLADFALLCLDGKRKPVTEASSCHLAMTPHASRGVSDL

SEQ ID NO: 773836 - protein, 396 aa, Homo sapiens; identical to SEQ ID NO: 773833

SEQ ID NO: 773837 - protein, 87 aa, Homo sapiens
MSSPRGLSKSSPRGLSKSSPWGLSKSFLCRLSKSSPWVLSMSSPQGLSKSSPRGLSKSSPRGLSMSSPRGLSKSSPRGLIMSSPRGL

SEQ ID NO: 773838 - protein, 68 aa, Homo sapiens
SPAVTPTLLSLSPHTSSPAANLASSTLTWNLLPTPSSDITLVPIPITAHLGYCSSFLPASCFHPTPSV

SEQ ID NO: 773839 - protein, 182 aa, Homo sapiens
FNSSSVTYLESVQPRDKTQDLNPQLPPKKASLPFPNIAGAETNASTLFLSPTSRGPRPMPPLSSFPQHRGGRDQCLHSLPFPNIAGAESNASTLFHSPTSRGPRPMPPLSSFPQHRGGREQCLHSLPFPNIAGAETNASTLFLSPTSRGPRPMPPLSSIPQHRRGRDQCLHSLPFPNIAGAE

SEQ ID NO: 773840 - protein, 137 aa, Homo sapiens [sequence omitted]

SEQ ID NO: 773841 - protein, 119 aa, Homo sapiens [sequence omitted]

SEQ ID NO: 773842 - protein, 112 aa, Homo sapiens
HDTHRHTHRHRHTHRDTQNRSHGHTQTHTQITRTHTDTHTHRHTLIQTHTQTHTDHIGSKTSSSLSSIISFLTKTKDNRCQGMEMPVREGAVWIPMLEWEGTLWYRKNAVCV

SEQ ID NO: 773843 - protein, 87 aa, Homo sapiens
IVIADSGGSTRGEFMHPVGVHDSVRTPLVSPTTEASHLLQDLAKQKALDRSIKGFAKVGVRGISRVICIANAHPLLLVYIKTANKGE

SEQ ID NO: 773844 - protein, 105 aa, Homo sapiens
MLHLPRPPWPAMPLSRAYKNPETLAGRQTLRRAQQGRNTRVAGCREECTDRHQQVCRPSTWQKRQSLAGMVGGEPRPLSVLTPEENLPAPSPSGFPHLLRNTSTQ

SEQ ID NO: 773845 - protein, 169 aa, Homo sapiens
CPGLFKSFLVFPETFTRTLCHDYESSSYPRCGSRARKIGDGTAPLLESGWTGGSRDPQPPRWSGMGEVTTQGLSNSCLLTLPLAPAKQPLLASAEPLELQVPKKPFLTPALSLPLGQFRANGTAKEKAEESKKGAAQYPGEFRVPGWLTSKRRRPLGALGWGNAQRSSL

SEQ ID NO: 773846 - protein, 207 aa, Homo sapiens
LGRGRRRFRSSMAATEEERLAGSGEGERLDFLRDLHVRFFQRCLEVLPERCSSLEDKQVFPTEDRSNLNRCGFRGSSYLGILFNPSKAPGTAHPYDSGHIAMTYTGLSCLLILGDDLSRVNKEACLAGLRALQLEDGSFCAVPEGSENDMRFLYCTSCICYMLNNRSGMDMKKAISYIRRSMSYDNGLAQGAGLESHGGSTFCAIAS

SEQ ID NO: 773847 - protein, 121 aa, Homo sapiens
GPREHSDAWVWSCSWVTAVVPQSTGLLPRGLGREWGSPHSQPPPSPTWLHGAHGPSHTSPAAASIFTATAPDRLPLLSTSYLNMKSGTLFLLDQGQYKNAHSYNFFFFWCLALSPGWSAVA

SEQ ID NO: 773848 - protein, 295 aa, Homo sapiens
AVVSSLVNGSTFVLQKKGIVRAKRRGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 773849 - protein, 277 aa, Homo sapiens
ARRASRSGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 773850 - protein, 92 aa, Homo sapiens
AVVSSLVNGSTFVLQKKGIVRAKRRGTSYLTDIVWWAGTIAMAVGQIGNFLAYTAVPTVLVTPLGALGVPFGQMPKSLQRSVSMMGVLKFTP

SEQ ID NO: 773851 - protein, 290 aa, Homo sapiens
AVVSSLVNGSTFVLQKKGIVRAKRRGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLGGLLAKGFPNSRPVSMADTSLYMVFKQVIFYRAVRD

SEQ ID NO: 773852 - protein, 250 aa, Homo sapiens
MFTAPHLQVLLTVGTMSDGVLDKKPVFNLESQSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFSPRVFPIHDQSPWQTRLYYMVFKQVIFYRAVRD

SEQ ID NO: 773853 - protein, 797 aa, Homo sapiens
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 773854 - protein, 367 aa, Homo sapiens
MVCDNLNLPFRDEGFDAIISIGVIHHFSTKQRRIRAIKEMARVLVPGGQLMIYVWAMEQKNRRFEKQDVLVPWNRALCSQLFSESSQSGRKRQCGYPERGHPYHPPCSECSCSVCFKEQGGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKEQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKGGCD

SEQ ID NO: 773855 - protein, 317 aa, Homo sapiens [sequence omitted]

SEQ ID NO: 773856 - protein, 367 aa, Homo sapiens; identical to SEQ ID NO: 773854

SEQ ID NO: 773857 - protein, 344 aa, Homo sapiens
DTSYVRHTEDSNEYHPGSGSPCREATDANVWSCGINCTVGDDSQDVLVPWNRALCSQLFSESSQSGRKRQCGYPERGHPYHPPCSECSCSVCFKEQGGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKEQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKGGCD

SEQ ID NO: 773858 - protein, 73 aa, Homo sapiens
QRLAQRAGLLSSMSELIKMLAPGGHQGHPGQPFCLLISIVPLLPHLTITTAVEDLTSTGRPEGERRKGSEDKS

SEQ ID NO: 773859 - protein, 72 aa, Homo sapiens
VHNVQMDVDNCPQGCPGAGPSPATTPPDTARFSPNGGADRTVHGSLSGPSNTSSIIHSREKRGGQRPASPPF

SEQ ID NO: 773860 - protein, 112 aa, Homo sapiens
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGL

SEQ ID NO: 773861 - protein, 79 aa, Homo sapiens
CLMHGRAGLGEAERSEKRDAGRNHGPDPQSRRAATGPGVTLASPAEGYTPWRRFCLSYNTVKAIKSSGGGGGATCGDTR

SEQ ID NO: 773862 - protein, 132 aa, Homo sapiens
AGPRPFFRPCRRVWSSALARLSLFRGPPAAGLRSGVAGPFFLPENQPEWRGAALSGPLCPQGPHGHPTGGPLPGRLHPQPSWKWEAAGRGKGLERAGLRRREPSGGAHRWGSPAPAGVRETARAPPRKGSFA

SEQ ID NO: 773863 - protein, 96 aa, Homo sapiens
GEGWVCPAAGLKPKSEVTPTWFSSWPARCPPGSVGGLSALPLASALSPPTPGRLAGTCTLGLGRRADCQPRGHLASLLGGVVTRHRAQDSGEGSAL

SEQ ID NO: 773864 - protein, 140 aa, Homo sapiens
SGGVLPRPAGSLFPGGGSWTQLFAGPPGSGEPRPAAANRPVESKSKVGSAGQRPGTMREARQSGLQAQPLGILRDPRLIMRLNPTPRTRDSKSPSPPTAPDPLPLSLQRRVCGRERDAGREKRGEGEHLFISFPPSICHL

SEQ ID NO: 773865 - protein, 126 aa, Homo sapiens
MPVKPPVLSSFRTATMVRMNVLADALKSINNAEKRGKRQVLIRPCSKVIVRFLTVMMKHGYIGEFEIIDDHRAGKIVVNLTGRLNKVGVQWHDLGYCNLCLPGSSDSPASASLVAEITVWGDQPQI

SEQ ID NO: 773866 - protein, 115 aa, Homo sapiens
MPVKPPVLSSFRTATMVRMNVLADALKSINNAEKRGKRQVLIRPCSKVIVRFLTVMMKHGYIGEFEIIDDHRAGKIVVNLTGRLNKCGVISPRFDVQLKDLEKWQNNLLPSRQFG

SEQ ID NO: 773867 - protein, 75 aa, Homo sapiens
LSRGSLRCWALGWARLSGATSHPALVCVEALLPPLPPLGGALARAHGSLTSCDLSEHISPWNSAGFHPTFLLFLL

SEQ ID NO: 773868 - protein, 319 aa, Homo sapiens
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQL

SEQ ID NO: 773869 - protein, 241 aa, Homo sapiens
MGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQL

SEQ ID NO: 773870 - protein, 143 aa, Homo sapiens
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKVRHWSETRFYFFFHCMYLE

SEQ ID NO: 773871 - protein, 98 aa, Homo sapiens
IRRMRKPRRAGWETLSRKAPGPSAGLRPSPATCDTCHFPILGDGNATLPFAPGKTSRVPSDSGDFSSHPRANWSSIRDFPSAKCVGIELHASLSTSAE

SEQ ID NO: 773872 - protein, 501 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 773873 - protein, 476 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLGFQAIHLSMRRWKKMIMRTMIRIIFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 773874 - protein, 470 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 773875 - protein, 470 aa, Homo sapiens; identical to SEQ ID NO: 773874

SEQ ID NO: 773876 - protein, 470 aa, Homo sapiens; identical to SEQ ID NO: 773874

SEQ ID NO: 773877 - protein, 541 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELECGSGDPRFPSAQGFHLSHPLQLRKPPFWTLGVPGPCALLSQLPGVGSSPKCSCPTPDSAQRQAQGLVSLRATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 773878 - protein, 193 aa, Homo sapiens
LEYNAKTIPLLRESLHPMLLSIIITVADNLNSKNSGIYAAAVAVLDAMVESLDNLCLLPALAGRVRFLSGRAVLDVTDRLAVLVASVYPRKPQAVERHVLPILWHFLNTATRNGTLPGPSGNIRGVVCRLSRSLQEHMGSRLLDFAASQPKHVLKTLQELLDSESLGGSRKATDRGVAPDSKTTGSSYPFQLD

SEQ ID NO: 773879 - protein, 124 aa, Homo sapiens
MLECSGTTSAYCNLHLPGSSNSPASASQVAGTTETSALNQYHGSSSSDKDSHGVAILTVLVMLVPGPSGTPPPVWSALELYTGPRVSQDCQKGLARIHLGEGSASLQSCWIERTFILSYIIEEL

SEQ ID NO: 773880 - protein, 223 aa, Homo sapiens
MQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGVGRFIKYFVKGRQAVLSMVRKAKVPGNWSYQSSWAGGRLSWCGLASPTMCTTSLGPAYWTALYPSGTSSAARDMKSALLVRL

SEQ ID NO: 773881 - protein, 37 aa, Homo sapiens
MGEEATCVTFNIPFISSHWAHFKRQRSPHPAAPPPAP

SEQ ID NO: 773882 - protein, 162 aa, Homo sapiens
PSFSLSSLGALCSCLLCLRLSGDWALPSLPLLPPPVSRSHRPQGHRYFRVMKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVVSPGARPR

SEQ ID NO: 773883 - protein, 171 aa, Homo sapiens
DVRVGLRQRGRVPARHPPLTLGGSKGTSLLAPGVSAPAARPAWLCGISALAPAPAPARVMKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVVSPGARPR

SEQ ID NO: 773884 - protein, 345 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 773885 - protein, 280 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGKMWKLTFSPPGTEAIYPRFS

SEQ ID NO: 773886 - protein, 280 aa, Homo sapiens; identical to SEQ ID NO: 773885

SEQ ID NO: 773887 - protein, 328 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 773888 - protein, 272 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGASLQGRASEHSLFRSAVC

SEQ ID NO: 773889 - protein, 241 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCAGNQLCPSLLVSLRDHSEELQGLNVGHIL

SEQ ID NO: 773890 - protein, 51 aa, Homo sapiens
SSIPAVLKVLCLASQAHYRLQRSNDLLRRKLRRQEALRSCTSSTCVILREY

SEQ ID NO: 773891 - protein, 111 aa, Homo sapiens
MLPDLELYYKATVTKTAWYWYQNRDIDQWNSTEPSEVIPHIYNHLIFDKPDKNKKWGKDSLFNKWCWENWLAIRRNLKLDALLTPYTKINSRWLKDLNVRPKTIKTLEENL

SEQ ID NO: 773892 - protein, 89 aa, Homo sapiens
RGKANCQTETRDKEKQSEGSRQTEKRRPTEKGKDAQRKRRKDRKTAGWENTDSVVDIRPGLKELRSGEVKAGRAQSAIQIESWMYTASA

SEQ ID NO: 773893 - protein, 263 aa, Homo sapiens
ESAGPPVAAPSRFRTKRCGQATGPAGNIMAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 773894 - protein, 172 aa, Homo sapiens
MFLPRLRGRYSSPACQHDQAPLLPLDVTDSSFSFMAFFFTFMAQLVISIIQAVGIPGWGVCPTLASSCSGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 773895 - protein, 279 aa, Homo sapiens
RPAPRRIARVQRSSAQRCGLSAAERPRQFRTKRCGQATGPAGNIMAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 773896 - protein, 279 aa, Homo sapiens; identical to SEQ ID NO: 773895

SEQ ID NO: 773897 - protein, 111 aa, Homo sapiens
MNSCSVAQAGVQWCDLSPRQPPSPGFKRFLCLSLPSSWDCRRPPPCLANFCIFSRDRFHHVGQAGLEPLTSSDPPALPFSWCRCCSLFLELDVPQLAVELPEPMCLSLVTE

SEQ ID NO: 773898 - protein, 279 aa, Homo sapiens; identical to SEQ ID NO: 773895

SEQ ID NO: 773899 - protein, 168 aa, Homo sapiens
MHLNLEGLGGLEGREALALCPGDGSHLLCRRTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 773900 - protein, 328 aa, Homo sapiens
ESAGPPVAAPSRFRTKRCGQATGPAGNIMAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAARLSIPPPPITRTPMRCEPATPTRWQSWGHWDRGLKPHRHLWLPSRVPPSLFSFPTLYKGPELYIYIYMYMSVPQPPPFRFCSWHSAVGCTWSCPVR

SEQ ID NO: 773901 - protein, 279 aa, Homo sapiens; identical to SEQ ID NO: 773895

SEQ ID NO: 773902 - protein, 106 aa, Homo sapiens
MMLLWNESEHSEVAKHGGKSKGCGADTQVQIPAPPCASCLPLSKLLTHSDAQFSHLQDGGNSGKLLMVLFEQLNESQCTKHQAGCSARSQVLTGGKLLRLLAKIYP

SEQ ID NO: 773903 - protein, 414 aa, Homo sapiens
CSLRSQCRAPAAPRLPARRTSGSRGAPSPQRRLPARAASDRRPRAATGRGDRAAACGRGAGQRWGLRLLSPEVPGSLRQDARGEAAEAAPTSRRTGRRAGMGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 773904 - protein, 321 aa, Homo sapiens
MTYHLYPAIFDVEESTSAPWTGCCCTQQPHPCQEAFRLCGFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 773905 - protein, 473 aa, Homo sapiens
GGCIWSSRGGQAQLRGARARTAAAMRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 773906 - protein, 121 aa, Homo sapiens
MSHPEFILWLTCIFFCGSSSFCVPQVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEE

SEQ ID NO: 773907 - protein, 131 aa, Homo sapiens
MAKRPGSPGSREMGLLTFRDVVIEFSLEEWQCLDHAQQNLYRDVMLENYRNLVSLGIAVSKPDLITCLEQNKEPWNIKRNEMVTKHPVMCSHFTQDLPPELGIKDSLQKVIPRRYGKSGHDNLQVKTCKSM

SEQ ID NO: 773908 - protein, 729 aa, Homo sapiens
FFKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 773909 - protein, 711 aa, Homo sapiens
FFKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEALVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 773910 - protein, 729 aa, Homo sapiens; identical to SEQ ID NO: 773908

SEQ ID NO: 773911 - protein, 221 aa, Homo sapiens
DSDSPFNYSWPSFPKMKIRRRTSKQDRSFDILKKSKPPSTLLAAGRLSDMLNGGDEVYANCMVIDQVGDLDISYINIEGITATTSPESRGCTLWPQSSKHTLPTETSPSVYPLSENVEGTHLEHQLPLPGKNPSLQFFKDKTAHSSLSLLPGYTFPQRKTGISCLPSSMGLCVRNQEIFSSCSEILVCILVSINILYLIILLCNFNIMCRTIVKHSFHTDI

SEQ ID NO: 773912 - protein, 675 aa, Homo sapiens
FFKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGN

SEQ ID NO: 773913 - protein, 755 aa, Homo sapiens
FFKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 773914 - protein, 319 aa, Homo sapiens
DSDSPFNYSWPSFPKMKIRRRTSKQDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRN

SEQ ID NO: 773915 - protein, 399 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 773916 - protein, 212 aa, Homo sapiens
MSSWLSAGSPSSLSVVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 773917 - protein, 431 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVLWLTPVIPTLWEADGGGLHEPVELETSLGNMVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 773918 - protein, 431 aa, Homo sapiens; identical to SEQ ID NO: 773917

SEQ ID NO: 773919 - protein, 118 aa, Homo sapiens
RACVRACVCVCASALCPEPTIPELAGPKEVKSHFSAPGRAKKRENQPVCSLLGSTRPLTVFCPLFCTRHIWERETKLLSLFHHLFSHSLCVRSSIIQQMPFQMQQSHLAGTGEKLFPC

SEQ ID NO: 773920 - protein, 50 aa, Homo sapiens
AHEGRITTLRKKKKGKDGAGAKEADKGTSKAKAEEDEEAERILPGILNDT

SEQ ID NO: 773921 - protein, 109 aa, Homo sapiens
KTKPKPLSWLYHFFHPFHTVPYAEALFERVVCGRFLTFSSFHSSQASIPSLHGDCSCQLYQNFHLAAAVVTSVVILSFHDLGTMAFTLLLEMLFPISCHSSGFTASQSP

SEQ ID NO: 773922 - protein, 135 aa, Homo sapiens
NSYSSLKFQEWWLILDLHRQTQTPGFRNTFTPFLVSPIRVLISVCMIIKYLSFLLECKLHEGRTLSLLDYGFLMPKSLAGASVNHQHYLSLAMRRGLFQHHVGLLVLFSHKQPYAVSSIVLIYRGGSDTQRGRSP

SEQ ID NO: 773923 - protein, 95 aa, Homo sapiens
CRSMHMYTHRFTSVHTCLHTCRYMHTHTHRYTSTHTHLHAHAHRYTSTHARLQAHTQVHEHTHASTHTHRYMSSHTHLHAHAHRYTSTHTPPRTQ

SEQ ID NO: 773924 - protein, 147 aa, Homo sapiens
RELLKIESRRVIRTWSDLCFGGLTFTAVRSGYEGERTEDGVATKKTVIQVTEEAGLTRTGELDCTSISLADATRPTEPLTIAKNPFLINKKSGCPHGRLLISTSLIYWLYIILSQTSTYGHKGRKKEPRKKNGRYTQDKQMSEEMIF

SEQ ID NO: 773925 - protein, 227 aa, Homo sapiens
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIMQLLMKGNRQRTQEPTAANQTSSRSHAVLQVTVRQRSRVKNILQEVRQGRLFMIDLAGSERASKTQNRGQRIEG

SEQ ID NO: 773926 - protein, 244 aa, Homo sapiens
RLSWSRALWIAPPPAAIMKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIMQLLMKGNRQRTQEPTAANQTSSRSHAVLQVTVRQRSRVKNILQEVRQGRLFMIDLAGSERASKTQNRGQRIEG

SEQ ID NO: 773927 - protein, 199 aa, Homo sapiens
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIYNEMIRDLLNPSLGYLELREDSKGVIQVAGITEVSTINAKEASFVW

SEQ ID NO: 773928 - protein, 205 aa, Homo sapiens
AAVLPADPVLAAVRAGAGEFRACPRAVRGEAGPGVGARPPALRLAPPAPLPEGKVAAARGRPGQRFHSAELEIGIQPSVGSGGMENCTVPHRFTSCHAVALASAKGAFRRFRQPPRMAAPDLAHGGHASRDSVCLHEEQTQAAGWWLAGLINLFQDAVTFDDVAVDFTQEEWTLLDPISENLYRDVMLENYENLASARTSPVPTQ

SEQ ID NO: 773929 - protein, 172 aa, Homo sapiens
CDPFALVALPGPSASGPRCSAWPQWTFTCARDVPHLLPPGIWVSQLYSRVLWFMCSGSGALPSEAASASLRFGLLRLCCPPPGTSGAPRAPSASAASRWALAALATSRGLPQPERRGRLGRRGVLTLVPLESPPCYEDCPLASRCSLSTDDSALPGVIGQRLLSETSLTGPQ

SEQ ID NO: 773930 - protein, 172 aa, Homo sapiens; identical to SEQ ID NO: 773929

SEQ ID NO: 773931 - protein, 180 aa, Homo sapiens [sequence omitted]

SEQ ID NO: 773932 - protein, 55 aa, Homo sapiens
MSAQGQFRLTTGSSSGSPPTSPSDPGQMPPLHPRSYFLNRELLDSVPCKDPTSSA

SEQ ID NO: 773933 - protein, 235 aa, Homo sapiens
SLCRGAGAGSVRRSPRGRTFPPSQVTKCGSRAWQKLLRPRALAWPRPVGCVLVSSCPQALPVPTVRPASLPGPAAGWRQLRRTPRSRGLGSRFFPDLLLSRVPPRPAVGTRPHPKPIAGLRAPGDPGWPCLSVGPGMRHSRQEGAPPRPGLSLEPRSCRRGAFCGCPHTTPGKGWGRGTLHDMAAGRSHFFETSVNWTRPTSHTLGEPRERLWPGGLQGVGSGGGERPQPFPVPP

SEQ ID NO: 773934 - protein, 134 aa, Homo sapiens
MRWVRARCLLGCARAPLPACPPARLLACWGCSVGLTGERARRSSVRNHIDTIVETAAQVTAPRALHQTLGSRDYFSLFRSIQLFADCKKMFLWLFLILSALISSTNADSDISVEICNVCSCVSVENVLYVNCEK

SEQ ID NO: 773935 - protein, 329 aa, Homo sapiens
SFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFP

SEQ ID NO: 773936 - protein, 67 aa, Homo sapiens
LVHLDAETRHRRVQGPAWLLKPLELGMSLCQVHLVLPSLLCLKPTGAPLEAETSPGYTARELEPGGN

SEQ ID NO: 773937 - protein, 76 aa, Homo sapiens
ALSHLNKKMSFCKPGKEPSPAIRSAGTLNLDFPASRTRLKTDTAQIASEAPWAIMDAELRVTLTVEDRNVRPLSPS

SEQ ID NO: 773938 - protein, 217 aa, Homo sapiens
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGG

SEQ ID NO: 773939 - protein, 82 aa, Homo sapiens
REWTRGCVPGRHHLRAVWQRLWKETGLRRLVNAEGNRLTGKEAIHFFKEEGSERRNVDPWGFHSCGKYENLWFAKLLHSLCY

SEQ ID NO: 773940 - protein, 31 aa, Homo sapiens
MSRAPLARTKPGRPRETSVHEGFLLDSAAAA

SEQ ID NO: 773941 - protein, 106 aa, Homo sapiens
MVSPGPRRDHSTYCDFCFRTAFPFARNPPEVRHCRAPAEQLGVAAPDPAVGRARVPAAPGRALRARTRPRRPAHLPPTPGLTRGQPRGAGCVEAEPRSPPSSRTRP

SEQ ID NO: 773942 - protein, 116 aa, Homo sapiens
MSLHLLAKSSGALVISSVQSPTGSSAAEETASLGARTCDDDLTEQQLRSTSEEQSEEAEGAIKPTAVAEDDEKDTSERDNSEGKNSNKDSGIITPEKELKVSVAGGTQPLLLAKEE

SEQ ID NO: 773943 - protein, 97 aa, Homo sapiens
KVKLNLVQHVRSVKHQQTEGLRKLQLHQQGLAPEEDNLSEIFFVKDCPPNELETASLGARTCDDDLTEQQLRSTSGNGSYSFSKYFLVLNELLLLLS

SEQ ID NO: 773944 - protein, 168 aa, Homo sapiens
AAAGSACAMGLPTLEFSDSYLDSPDFRERLQCHEIELERTNKFIKELIKDGSLLIGALRNLSMAVQKFSQSLQDFQFECIGDAETDDEISIAQSLKEFARLLIAVEEERRRLIQNANDVLIAPLEKFRKEQIGAAKVSVTFYYSSVILLIIKDDIISDVNIFEIRMTF

SEQ ID NO: 773945 - protein, 215 aa, Homo sapiens
NVPVSGIRGSHHRKHVAASDIQGSYCMKHVPASNIPGSHHMKHVPASSILGSHHMKHVAESGIWGSHHGKHQAASGIRVPITGSTCLCLAADGIQGSHHGKHVAASGIPGSHHRKNVPVSGIRGSHHRKHVAASDIWGSYCMKHVPASSIPGSHHRKHVAASGCVWYLGFPSWEAHACIWYTGFIYFPALILYLNPSSISYEFLFSSICTLLSTS

SEQ ID NO: 773946 - protein, 157 aa, Homo sapiens
MWLVGENDSQHKRPCSACAVLSLILSTSASWRASTAAPLGPCSPVLASASSVTSPFLSYKHQRRSESLQGDGPLSSKHCEYVALWPKVVFVVVNVDTASACASCHRQLCRLDVRSQTSMRLPKGLAFGLRLLQSQGPSREVVYLVTIFDSNSAECWC

SEQ ID NO: 773947 - protein, 95 aa, Homo sapiens
MWNKNSGPTKHRYKEGCNTVALHALPVEGSYPTRREAAAGGSRGDRTDRAVNMPPSMGLQMVGLKELLAHGNTPSEVSGLRTPVWAPPCSPQCDM

SEQ ID NO: 773948 - protein, 196 aa, Homo sapiens
LRSWRRGTTARATMGDQRLQDWLRSPGMDSKPWYCNKRPSKCFAKCKHRRLRFPPMDTQNWVFVKEGMDDFRYGCPSPEDTLVCRRDEFLLPKISLRGPQADPKSGQKKLLKKAALFSKLSPAQLARKAFVEQVEAQLMAKHPLAMYPNLGEDMPPDLLLQVLKHLDPERELEDAWACCETQEKTTEVPTEPGKHP

SEQ ID NO: 773949 - protein, 216 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPRDPCDPAAPRAGVEDAFYTLVREIRQHKLRKLNPPDESGPGCMSCKCVLS

SEQ ID NO: 773950 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 773951 - protein, 189 aa, Homo sapiens; identical to SEQ ID NO: 773950

SEQ ID NO: 773952 - protein, 189 aa, Homo sapiens; identical to SEQ ID NO: 773950

SEQ ID NO: 773953 - protein, 189 aa, Homo sapiens; identical to SEQ ID NO: 773950

SEQ ID NO: 773954 - protein, 231 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQPGEVAGESGASGQARLDPTAGSPSPRQAATGRSLLIPSLLSQGVEDAFYTLVREIRQHKLRKLNPPDESGPGCMSCKCVLS

SEQ ID NO: 773955 - protein, 102 aa, Homo sapiens
MRVALGTFEMARVQLPVCVVGLGKWLVESGASGQARLDPTAGSPSPRQAATGRSLLIPSLLSQGVEDAFYTLVREIRQHKLRKLNPPDESGPGCMSCKCVLS

SEQ ID NO: 773956 - protein, 151 aa, Homo sapiens
RPRPRHARAPPIQHHRSRTRPGASAPVPFPSPGLPRRFSAPSCRSVPASQELLCLLQLSVAERCPRFPAGGAGRCPGLPSPRRRLVRSRRSANTCRRHQRRGACRLALACPGTPWRAPPWPDLFWRTVTSALGRLPLAFLPTQQLLIWVRG

SEQ ID NO: 773957 - protein, 189 aa, Homo sapiens; identical to SEQ ID NO: 773950

SEQ ID NO: 773958 - protein, 189 aa, Homo sapiens; identical to SEQ ID NO: 773950

SEQ ID NO: 773959 - protein, 189 aa, Homo sapiens; identical to SEQ ID NO: 773950

SEQ ID NO: 773960 - protein, 58 aa, Homo sapiens
TTRTKYHRLRGSYNRSYFFTVLESGKSKVKVPAASVPGKDSLREKTAAFSLCAHGDCP

SEQ ID NO: 773961 - protein, 181 aa, Homo sapiens
ANGEIRLTTCMAHKICGRSRQLDQCDGRSQRGGTIYILGRPYSDLLKESRRSLRLSFVENSGVCLTSGDAELEIPVLSRLPKQPSRPPLLTSVLGTREKQILPQTCLGPHSALSSWPAPTGHNFRSNQYPHISHCKGKFESFSGDSLDVAVLSPLTGKKELMSTLTFQGPPGAPRHFCGLL

SEQ ID NO: 773962 - protein, 100 aa, Homo sapiens
SASSASPRVCCPRHPVGAVHGERIMAIEGGERTCGVHELICIRKVSPEAVGFLSAVGVFIILMLLLFLYINKKFCFENVGGFPDLGSEYSTRKNSQDKIC

SEQ ID NO: 773963 - protein, 117 aa, Homo sapiens
IQQRQPCPQEPPQSSNELVVFRQTLQGVGGASLDLSCAEPHHKVSNENVLSLPRVVAHHQPSAVRVSQFAYLDRFSHRADLVDLQQQTARDLLLKGLGNPLGVGDCQVIPHNLDVHP

SEQ ID NO: 773964 - protein, 74 aa, Homo sapiens
PFRTGDFFYLDNTFLLFFHIFTLLQDQKPKPHDWMSRHLAFIRVVMVLTVVDVLPPDMLESLHFGNNFKCKSLI

SEQ ID NO: 773965 - protein, 74 aa, Homo sapiens; identical to SEQ ID NO: 773964

SEQ ID NO: 773966 - protein, 185 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQG

SEQ ID NO: 773967 - protein, 225 aa, Homo sapiens
MSRAVRLPVPCPVQLGTLRNDSLEAQLHEYVKQGNYVKVKKILKKALELPQTALRSEEEWRSKEENNRALLHPAVRRREEIGIGLGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQG

SEQ ID NO: 773968 - protein, 155 aa, Homo sapiens
ASDVRTAHTASISPPTMASDVRTAHTASISPPTMASDVRTAHTASISPPTMASDVRTAHTASISPPTMASDVRTAHTASISPPTMASDVRTAHTASISPPTMASDVRTAHTASISPPTMASDVRIAHTASINPPTTASVCDVCSVCDVCSICNVH

SEQ ID NO: 773969 - protein, 110 aa, Homo sapiens
VHSARQHRTPEPQLFLPLARQPWCQALSEPHQEEARAGCSPSALGLWPAASSACHSPTPFPPLKTGATPAPTGQNYLKWHKTIVQQTHLFSKVFRAQTQTPPCRTHGYRG

SEQ ID NO: 773970 - protein, 236 aa, Homo sapiens
RRGPFSRFSACDLITAAGWRGASRDFFLHCSPSSFSSRLKFEERTTWLKLGSRFPKLPSEEKALTMEDSEFLAYVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQY

SEQ ID NO: 773971 - protein, 61 aa, Homo sapiens
MKSRRRKAAQSLGKSICAEPGLGCFTGASGGRISPGKGTFKPRVQMPTKGTRSEGAMAPEG

SEQ ID NO: 773972 - protein, 267 aa, Homo sapiens
SGESPAVENGKWPRPCCRVRPRGWCLAQAAPRFLPTLWEERVCARFPRSTSPGPTSDRGRWAGAAGRLEGSRRHAPAARRSPGPGAGLRPPGKIELHGKPIEVEHSVPKRQRIRKLQIRNIPASFTVGDEPLVELRLNRTYPLKRNACSIFPCDSALEMFTQNEVLDSLLVQYGVVESCEQVNTDSETAVVNVTYSSKDQARQALDNLNGFQLENFTLKVAYIPDDHGRQQNPLQQTRGRRGLGAKGLLKAGVSRIRIRADTHVICL

SEQ ID NO: 773973 - protein, 149 aa, Homo sapiens
QEVFEPPHYELCTLRGTGATADFADVADDFENYHKLRRSSSKCIHDHHCGSQLSSTKGSRSNLSTRDASILTEMPTQPGKPLIPPMNRRNILVMKHNYSQDAADACDIDEIEEVPTTSHRLSRHDKAVQRFCLIGSLSKHESEYNTTRV

SEQ ID NO: 773974 - protein, 149 aa, Homo sapiens; identical to SEQ ID NO: 773973

SEQ ID NO: 773975 - protein, 79 aa, Homo sapiens
PSAGPVAGEGRRGSGTGASTWVGGCSSFQTLGEGALPKLSWHWGCAFEGDGGSRSEEDTLLTASSPSSGLCCGNGREEV

SEQ ID NO: 773976 - protein, 202 aa, Homo sapiens
FKNAVGNLAMEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKTYVKCVGQKEHLRNRFIILGYVLAVLKLSIMNGKYTFRKVCKSEL

SEQ ID NO: 773977 - protein, 242 aa, Homo sapiens
FKNAVGNLAMEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 773978 - protein, 233 aa, Homo sapiens
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 773979 - protein, 309 aa, Homo sapiens
FKNAVGNLAMEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIFIAYYYLFTKPSSQTLSFHCCCASPLMERCSGFSAMFVRPPRGLADLESIMEVFQVNLNVYSDIEVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 773980 - protein, 182 aa, Homo sapiens
FKNAVGNLAMEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVCKAENGPREIQGKILLFKISMTEN

SEQ ID NO: 773981 - protein, 242 aa, Homo sapiens; identical to SEQ ID NO: 773977

SEQ ID NO: 773982 - protein, 216 aa, Homo sapiens
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKMLQLEKKLERELEDDARVIACRFPFPHWTPDHVTGEGIDTVWAYDASTFRGREKRPCTSMHFQLPIQA

SEQ ID NO: 773983 - protein, 199 aa, Homo sapiens
MAKSAEVKLAIFGRAGVGKSALVVRFLTKRFIWEYDPTLESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 773984 - protein, 144 aa, Homo sapiens
MEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 773985 - protein, 199 aa, Homo sapiens; identical to SEQ ID NO: 773983

SEQ ID NO: 773986 - protein, 199 aa, Homo sapiens; identical to SEQ ID NO: 773983

SEQ ID NO: 773987 - protein, 199 aa, Homo sapiens; identical to SEQ ID NO: 773983

SEQ ID NO: 773988 - protein, 708 aa, Homo sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNLLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 773989 - protein, 219 aa, Homo sapiens
MLRMRVPALLVLLFCFRGRAGPSPHFLQQPEDLVVLLGEGGAQASLGRRASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 773990 - protein, 623 aa, Homo sapiens
MLRMRVPALLVLLFCFRGRAGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNLLGEGGAQASLGRRASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 773991 - protein, 219 aa, Homo sapiens; identical to SEQ ID NO: 773989

SEQ ID NO: 773992 - protein, 237 aa, Homo sapiens
STAPSLTPTESLDLYMQSQAAREHKPGASRLLLLLLLPLPPPPPPLPPPALRTRDFSCTTLSACFPPCPEKCDRSPKEFPRQVLGGNDSPVIFPALTQSAGWPPSQEDCFLRNAGHRKRLLMDLHRAAFKMENSSYLPNPLASPALMVLASTAEASRDASIPCQQPRPFGVPVSVDKDVHIPFTNGSYTFASMYHRQGGVPGTFAIVISPLLYYTSTLNLSPKSRLHPISMLNHSGV

SEQ ID NO: 773993 - protein, 115 aa, Homo sapiens
PAPASLLSSRLQYLPRFAPSLSARLKSSRFPWGLILLWARCLQHSAPRLAQLPTLAPCSAVPAMSFPLPPPLHPHHSVPSSDPFSLLASDRRTCFLTSLPAVIVSLPSLMLELTF

SEQ ID NO: 773994 - protein, 131 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILDDIIVSLKSDNFTIPSGEYSC

SEQ ID NO: 773995 - protein, 131 aa, Homo sapiens; identical to SEQ ID NO: 773994

SEQ ID NO: 773996 - protein, 113 aa, Homo sapiens
MNESPDPTDLAGVIIELGPNDSPQTSEFKGATEEAPAKESVLARLSKFEVEDAENVASYDSKIKKIVHSIVSSFAFGLFGVFLVLLDVTLILDDIIVSLKSDNFTIPSGEYSC

SEQ ID NO: 773997 - protein, 106 aa, Homo sapiens
LVSAALGQPVNGCAASSAPQQSAPVGALALSLGVTGGRASPTRSRGAAHMAAATEDTRSCQHPHNSCPPAGSSGLRTPPARTFIAQLSKPWRRGHSMCPPWKGLNL

SEQ ID NO: 773998 - protein, 106 aa, Homo sapiens
MITPLASAETNEDMAVVWKLLREGNVNIQATQGGQTALMLGVSHDREDMVQALLSCQADVNLQDHDGSSALMLACHHGNVDLVRLLLAHPACDSSLTDKGDSLSSV

SEQ ID NO: 773999 - protein, 183 aa, Homo sapiens
MITPLASAETNEDMAVVWKLLREGNVNIQATQGGQTALMLGVSHDREDMVQALLSCQADVNLQDHDGSSALMLACHHGNVDLVRLLLAHPACDSSLTDKGWPHSFVHRSEVTHPYGNCWASESPRGAGQVPGAVGAAEELAVGNKSLLLWTPPSPLKRAEVTGQRATLLEKKLCQICTYIPVV

SEQ ID NO: 774000 - protein, 570 aa, Homo sapiens
QLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTATDQLLRQSLNTISQEWFRVSSRKSSSPAVVASYLHEVQPHSPHFLKLLVNLADRNGNTALHYSVSHSNFSIAKLLLETGVCNVDHQNKAGYTAVMITPLASAETNEDMAVVWKLLREGNVNIQATQGGQTALMLGVSHDREDMVQALLSCQADVNLQDHDGSSALMLACHHGNVDLVRLLLAHPACDSSLTDKGWPHSFVHRSEVTHPYGNCWASESPRGAGQVPGAVGAAEELAVGNKSLLLWTPPSPLKRAEVTGQRATLLEKKLCQICTYIPVV

SEQ ID NO: 774001 - protein, 570 aa, Homo sapiens; identical to SEQ ID NO: 774000

SEQ ID NO: 774002 - protein, 85 aa, Homo sapiens
EERPAIVVAPSRYLFPSPLSRMTEHGGLEAYHFLLKQGRSERGWRSPEEHGKWRQSSLSATGEAFTKAIDKEVTCGFSRGKGFSV

SEQ ID NO: 774003 - protein, 72 aa, Homo sapiens
MAASTQTLGMEHQTLSAQRLPWLTVQQKILKLTEQIKMAQNSPGDNVAEYLKLANSATNRQAARISKSLRRQ

SEQ ID NO: 774004 - protein, 103 aa, Homo sapiens
MPVCMHVPHRVYVCRCVCMHVHAGSALCLCACMSHIVCVCVSVCVHACVCRFSSMPVCTHVPHRVCVSVCACMCMQVQLCLRASHRVCVCLRVYMHVSVGSRC

SEQ ID NO: 774005 - protein, 72 aa, Homo sapiens
APGTAGGTSSASAGAGRGRGLQGSWAEDKARSRVGASFKSVPSQLCKFLSIAACQRKFLKNGPQLYCGVIDG

SEQ ID NO: 774006 - protein, 49 aa, Homo sapiens
LAYTILLFKTNMRENQQESILTSRECPGAVHRKVLEKAAADSPGTRLFQ

SEQ ID NO: 774007 - protein, 744 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNVRENQKY

SEQ ID NO: 774008 - protein, 320 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQVETF

SEQ ID NO: 774009 - protein, 1063 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIAIKTSVIWATPNVSFSIPLWVIILAILLGLLVLAILTLALWKCGFFDRARPPQEDMTDREQLTNDKTPEA

SEQ ID NO: 774010 - protein, 518 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAAW

SEQ ID NO: 774011 - protein, 104 aa, Homo sapiens
FFLKTESHSVAQAGMQWCNLNALQPPPPRSNDSHASASRVAGITGVYDHAWLIFVFLVERGFYHVDQAGVELLTSRDPPACTFQSGGIMDMNHCTLFNNLNDVF

SEQ ID NO: 774012 - protein, 200 aa, Homo sapiens
GDGGSMRARGVTPFCWGSGEAKAETVPFVVSTAFYFLAVTGNCTNVLLSLPLHTPTSSATGPFSTSCHSTRSFSQVLVNRGGSGKSMARVGVRCGPLRPLAPGLAWPRRLRELPFRPDVAAYTYLGRCSHRCLCQFVCGTPAITAFPRGRRQGGTPGFPRPPQPPWRLSRDLASAPRGQCTAAHAVSAPGLPARLPPFPR

SEQ ID NO: 774013 - protein, 274 aa, Homo sapiens
QGTQPSSPSFRERLETMSGRGRGWVPTQVKARCPAGFCLSCTPAWRASRNPSWKDRALQRPPVSVGQHGLGSNPILSSHIACPQAPPHPVPCSTGLERDGSHVLAGTWHKHAADGISQDPRLRRAHAQESPIRALCLKGCMPRWAHAQEGPCPGWSMSRRASFPGGSRAQEGSMPKRVPCPGGSIRKGVHAWLGGGLCPGGSHAWKGPCSGGFMPRRVYALEGPMPGRVTCTEGPVLRRIHVQECPCPGGSMPRRLHVKKDSCLGGFMPRSVPA

SEQ ID NO: 774014 - protein, 143 aa, Homo sapiens
PGLPRDVPESQECIPSRLRACLALTPDPLLLRREIGAADRGPPQPPGMGLGGRFLSRCSRRRVDRLAWPQPGRHVAPVLPGWERQPSWELPGSCRQQVEGACSLGAQVVEHGLGGLWIASAPGLRARQALPLLGSSSAEARDL

SEQ ID NO: 774015 - protein, 343 aa, Homo sapiens
PGLPRDVPESQECIPSRLRACLALTPDPLLLRREIGAADRGPPQPPGMGLGGRFLSRCSRRRVDRLAWPQPGRHVAPVLPGWERQPSWELPGSCRQQDSGLGSQGRRDLGLETTSAHSRSLLHLSSWRRPDVGEAAGAELLQRAPLQQPDPAQAAVEGGLLARLPRPQDQGAASTALTPRVSWILPSLEAAGPKRGSQRSAPRRLACRAQDPAFWRRGTAPFSSPAPLLVGKLLSLCHEKHPGVLDFDIACTLSRAHQTGGCPQSPRVACSRAAAPAGCSSLWAYQAWWSHSRPVERKSKAGSAGQWAGTMREAGQLGSKLSLSDSPGPTAYNALKSHASPER

SEQ ID NO: 774016 - protein, 457 aa, Homo sapiens
PGLPRDVPESQECIPSRLRACLALTPDPLLLRREIGAADRGPPQPPGMGLGGRFLSRCSRRRVDRLAWPQPGRHVAPVLPGWERQPSWELPGSCRQQVEGACSLGAQVVEHGLGGLWIASAPGLRARQALPLLGSSSAEARDLSQWPSAATGNGAESRFPLQGRPPSSAAATGTSGPGSEMWGVLAGSGVAWRLLPAHRRRMQLGCPGGLEDSGLGSQGRRDLGLETTSAHSRSLLHLSSWRRPDVGEAAGAELLQRAPLQQPDPAQAAVEGGLLARLPRPQDQGAASTALTPRVSWILPSLEAAGPKRGSQRSAPRRLACRAQDPAFWRRGTAPFSSPAPLLVGKLLSLCHEKHPGVLDFDIACTLSRAHQTGGCPQSPRVACSRAAAPAGCSSLWAYQAWWSHSRPVERKSKAGSAGQWAGTMREAGQLGSKLSLSDSPGPTAYNALKSHASPER

SEQ ID NO: 774017 - protein, 82 aa, Homo sapiens
ALRPQAGVGTSLEPALRSPSTRNVERLWRHGANCARSLGPRAASVHGASRSPAQWTKSGMLGRHPTGLTPQRHPERDGVSPC

SEQ ID NO: 774018 - protein, 125 aa, Homo sapiens
MARSPTLRERNALMFNNELVADVHFVVGPPGATRTVPAHKYVLAACSSVFYAMFYWDLAEVKSEIHIPDLEPAAFLILLKYVYSDEIDLEADTVLATLLAAKKYIVPALAKACVNFLGTSLKAKN

SEQ ID NO: 774019 - protein, 291 aa, Homo sapiens
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 774020 - protein, 70 aa, Homo sapiens
SPLRSRCARRRRVGGEALTRGTLRASARATRVKRAPPGNFCGRRAEAPGRAGKERKYQNICRLDPNQEPR

SEQ ID NO: 774021 - protein, 291 aa, Homo sapiens; identical to SEQ ID NO: 774019

SEQ ID NO: 774022 - protein, 260 aa, Homo sapiens
MSSVKRPRGRPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEE

SEQ ID NO: 774023 - protein, 734 aa, Homo sapiens
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEE

SEQ ID NO: 774024 - protein, 734 aa, Homo sapiens; identical to SEQ ID NO: 774023

SEQ ID NO: 774025 - protein, 734 aa, Homo sapiens; identical to SEQ ID NO: 774023

SEQ ID NO: 774026 - protein, 734 aa, Homo sapiens; identical to SEQ ID NO: 774023

SEQ ID NO: 774027 - protein, 368 aa, Homo sapiens
MTDPMMDFFDDANLFGETLEEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEE

SEQ ID NO: 774028 - protein, 227 aa, Homo sapiens
MSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEE

SEQ ID NO: 774029 - protein, 193 aa, Homo sapiens
FFTPPLKTFGPLFSPKRFEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEE

SEQ ID NO: 774030 - protein, 658 aa, Homo sapiens
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQLLIQWESSGSRLLGCCKKLRKEDQID

SEQ ID NO: 774031 - protein, 501 aa, Homo sapiens [sequence omitted]

SEQ ID NO: 774032 - protein, 760 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 774033 - protein, 760 aa, Homo sapiens; identical to SEQ ID NO: 774032

SEQ ID NO: 774034 - protein, 730 aa, Homo sapiens
MLEDAVQVGGRGRDAALQITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 774035 - protein, 194 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEFYDLLIIAF

SEQ ID NO: 774036 - protein, 760 aa, Homo sapiens; identical to SEQ ID NO: 774032

SEQ ID NO: 774037 - protein, 650 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 774038 - protein, 141 aa, Homo sapiens
QISQLTKNISCRMFYLQKLQDGCTIISNGYITSIIHQHFIQDNGPRALFTILAIEAAAIMFWERIASPLLRSPNTDKGPSIFLAAVHTEFCSYCGQPVIVAPRPTGYHSSGDGVERTRVMHRPIRFPAAPAGRGARREADL

SEQ ID NO: 774039 - protein, 34 aa, Homo sapiens
MAHCESGAPDLLLLSIHSGMLPPPCKGLESTLVP

SEQ ID NO: 774040 - protein, 111 aa, Homo sapiens
QQQLIRETRISWLQAQMLNPQPEKTFIRNKAAQVFALLFVTEYLTKWPKFFVYILSVVDLNPRGVDVCLRILMAIDSELVDRDVVHTSEEARRNTLIKDTMREQCIPNLVE

SEQ ID NO: 774041 - protein, 47 aa, Homo sapiens
MICMVVPVTENDAGIRRAEIKQGIREVILCKDQDGKIGLRLKSIDND

SEQ ID NO: 774042 - protein, 106 aa, Homo sapiens
MWLRPGSCWSTREPRRAPRTSASSLSSFLGPSAVCTLLSSHPASRCRPSTFLAPGFCICPSHCLSCANATGPAHRTPHGIASPPLYLHTRPETCLSSCVSIDFCTI

SEQ ID NO: 774043 - protein, 117 aa, Homo sapiens
MPLPPCVVSTLQDFILGHPKAEDIAGQQEIHGASRKTSKRWWSRGRHTQTAVCNCAAAGCCGCWPAVHSGHTGLCHRMQAVAGGGTAGRQGLCAWKPAGLLQEEGCRMLQLRPDSGF

SEQ ID NO: 774044 - protein, 483 aa, Homo sapiens
MKVFRRKALVLCAGYALLLVLTMLNLLDYKWHKEPLQQCNPDGPLGAAAGAAGGSWGRPGPPPAGPPRAHARLDLRTPYRPPAAAVGAAPAAAAGMAGVAAPPGNGTRGTGGVGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 774045 - protein, 483 aa, Homo sapiens; identical to SEQ ID NO: 774044

SEQ ID NO: 774046 - protein, 483 aa, Homo sapiens; identical to SEQ ID NO: 774044

SEQ ID NO: 774047 - protein, 483 aa, Homo sapiens; identical to SEQ ID NO: 774044

SEQ ID NO: 774048 - protein, 102 aa, Homo sapiens
RYTVGAISVLVATIVIITRVFQELSLHGSPHRFTNSPVLGTSLNCNLNPRLMQPYKQTRIMAGVGALPFGIWPNQEEVEWPGGKPQVIQNVHHVVNPVLLLL

SEQ ID NO: 774049 - protein, 32 aa, Homo sapiens
KRSCSNLQSLSQTWVVTVSGGSQIIGDISETT

SEQ ID NO: 774050 - protein, 241 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPKKRDQTFSNLVPKVPWPNAAEYLLKH

SEQ ID NO: 774051 - protein, 252 aa, Homo sapiens
SGGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFMYLYQMMPWMIAALKEQLPELEKIVQQISEDARST

SEQ ID NO: 774052 - protein, 341 aa, Homo sapiens
MLGNTENWNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 774053 - protein, 322 aa, Homo sapiens
MLGNTENWNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQKDYSSFLSRKSKIKIAKDDCVFGNIKEEDL

SEQ ID NO: 774054 - protein, 292 aa, Homo sapiens
MLGNTENWNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMN

SEQ ID NO: 774055 - protein, 180 aa, Homo sapiens [sequence omitted]

SEQ ID NO: 774056 - protein, 110 aa, Homo sapiens
GAPASLPAFSSPGCDHSQLTPPLLWQPKNSLEKGQLAAFPRACLDPWTPVLRGVGAPSVGCMGHEHHWKQTSSFPCCSPLRLPAFLIRDFRRGMGRVAYNLPLKARCFGE

SEQ ID NO: 774057 - protein, 44 aa, Homo sapiens
LLLLNEKEKSPGCVCGYNRKHSSCQAELPRRCPRRQTQGHCHFF

SEQ ID NO: 774058 - protein, 108 aa, Homo sapiens
KATYMETTCLQLSYPRNSSSLVILSLFRWFLQTSGDASSPLHMEVGSMQHTACTHVPTCAHTHILTQPPALKHPPSLPPQSCLAQAQARGEGAYGGKQERGLGLNSKV

SEQ ID NO: 774059 - protein, 40 aa, Homo sapiens
MLPRLVFNSWPEVILSSWTAKVLGFGTTEPNPRREPLSLG

SEQ ID NO: 774060 - protein, 84 aa, Homo sapiens
TWGADALLPGAYGSAAPDGAFSLPPSSRFHLRRLLGLPSHPGPSSASRVLPGLVRNCSWRSRGTPKPANGKRRFAEIGTDDGKQ

SEQ ID NO: 774061 - protein, 167 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPE

SEQ ID NO: 774062 - protein, 112 aa, Homo sapiens
MTLCEGEENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 774063 - protein, 126 aa, Homo sapiens
MAAGPEPPEWEPRWRKALRGKENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 774064 - protein, 126 aa, Homo sapiens; identical to SEQ ID NO: 774063

SEQ ID NO: 774065 - protein, 231 aa, Homo sapiens
MQYTAARILSVERSAARTSGCSTPLPGSYRQSAPRSGPRPVRVPDPAPCASPALASSSCCWSPSGRRPSRSPALPAAPARDGPASEAALQLLCRADAGPLCAACRMAAGPEPPEWEPRWRKALRGKENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 774066 - protein, 157 aa, Homo sapiens
MAAGPEPPEWEPRWRKALRGKENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQVREPRWVCPPSGQGGRRQQRAIGGPLPEVKA

SEQ ID NO: 774067 - protein, 128 aa, Homo sapiens
MVRGWVVAARVGTALECKALRGEENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 774068 - protein, 232 aa, Homo sapiens
MQYTAARILSVERSAARTSGCSTPLPGSYRQSAPRSGPRPVRVPDPAPCASPALASSSCCWSPSGRRPSRSPALPSRSCALAGPAARSPGAPCGPRRGRLRPVPARAPGTGARRLRPPLLSGVRGALLGRGGRALPVPRVRRRLLAARRGARQAPAQPPPSGARGGGRGARARRPGQRGRAAAAVPRRRRPALRRLPYGCGPRAARVGTALEEGAARQGEQGVCGNHEKGLE

SEQ ID NO: 774069 - protein, 110 aa, Homo sapiens
KILKQHTHNKQKNTHYKIHHKKLGEDEARGLIGTEEGHVMDRRKKALTDYKKLRAFFVEEEEHFLQEAEKEEGLPEDELADPTERFRSLLQAVSELEKKHRNLGLSMLLQ

SEQ ID NO: 774070 - protein, 126 aa, Homo sapiens; identical to SEQ ID NO: 774063

SEQ ID NO: 774071 - protein, 126 aa, Homo sapiens; identical to SEQ ID NO: 774063

SEQ ID NO: 774072 - protein, 126 aa, Homo sapiens; identical to SEQ ID NO: 774063

SEQ ID NO: 774073 - protein, 126 aa, Homo sapiens; identical to SEQ ID NO: 774063

SEQ ID NO: 774074 - protein, 145 aa, Homo sapiens
MQYTAARILSVERSAARTSGCSTPLPGSYRQSAPRSGPRPVRVPDPAPCASPALASSSCCWSPSGRRPSRSPALPSRSCALAGPAARSPGAPCGPRRGRLRPVPARAPGTGARRLPSSRYVRMCPVRFSPEEMVPVLCPYSMNCG

SEQ ID NO: 774075 - protein, 126 aa, Homo sapiens; identical to SEQ ID NO: 774063

SEQ ID NO: 774076 - protein, 88 aa, Homo sapiens
TPPHQYALGTRPGWGHVMDRRKKALTDYKKLRAFFVEEEEHFLQEAEKEEGLPEDELADPTERFRSLLQAVSELEKKHRNLGLSMLLQ

SEQ ID NO: 774077 - protein, 107 aa, Homo sapiens [sequence omitted]

SEQ ID NO: 774078 - protein, 126 aa, Homo sapiens; identical to SEQ ID NO: 774063

SEQ ID NO: 774079 - protein, 126 aa, Homo sapiens; identical to SEQ ID NO: 774063

SEQ ID NO: 774080 - protein, 107 aa, Homo sapiens [sequence omitted]

SEQ ID NO: 774081 - protein, 403 aa, Homo sapiens
PCGPGMPSAGAAAPALEAPRRTGPRWAWGRAGAAAAELWILHDVMIWGHFSLLCVVDSLGGEEMADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 774082 - protein, 113 aa, Homo sapiens
PVDLTIPSVGQSIERKQESEPRIVSRIFQCCAWNGGVFWFSLLLFYRVFIPVLQSVTARIIGDPHYMEMLGLPGPILVIIETISLLIQPIALAVRLTANITAGHLLMHLIGSA

SEQ ID NO: 774083 - protein, 325 aa, Homo sapiens
PCGPGMPSAGAAAPALEAPRRTGPRWAWGRAGAAAAELWILHDVMIWGHFSLLCVVDSLGGEEMADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKVAAFSLSSFLYSLSAPMKQRPLAKHISSSCASSPWWSS

SEQ ID NO: 774084 - protein, 292 aa, Homo sapiens
PCGPGMPSAGAAAPALEAPRRTGPRWAWGRAGAAAAELWILHDVMIWGHFSLLCVVDSLGGEEMADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKEKASI

SEQ ID NO: 774085 - protein, 342 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 774086 - protein, 172 aa, Homo sapiens
MGSLHENLGPVSPDLHWLFAGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVLGSLHIVDLSFSCVGQDRVLNGSGHLLDVPDESLVV

SEQ ID NO: 774087 - protein, 342 aa, Homo sapiens; identical to SEQ ID NO: 774085

SEQ ID NO: 774088 - protein, 342 aa, Homo sapiens; identical to SEQ ID NO: 774085

SEQ ID NO: 774089 - protein, 342 aa, Homo sapiens; identical to SEQ ID NO: 774085

SEQ ID NO: 774090 - protein, 149 aa, Homo sapiens
SDMLGIRDFEPDKEQLQLFERMTTRLSSGTSSKCPEPLRTLSWPTQLKERSTMCSGHQLSPTGSPSATTTAWRYSECSVGGAVPTRQGLLYFLPLPHPQSKKKHVSSGQYVFHCFAPTVTRSCSRSSWPVTPSPSVADSVLCGASSAQG

SEQ ID NO: 774091 - protein, 342 aa, Homo sapiens; identical to SEQ ID NO: 774085

SEQ ID NO: 774092 - protein, 69 aa, Homo sapiens
PRGRGGVPKRKVVVVRSQAGLKLGVGLGRRRCLSPHPRFRVRPFLPAPSSPPFGPIDLRLGSPPAAAHC

SEQ ID NO: 774093 - protein, 342 aa, Homo sapiens; identical to SEQ ID NO: 774085

SEQ ID NO: 774094 - protein, 222 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGREPGHLESPPPFHPGHGGQVVRVLLVPAEAKQWV

SEQ ID NO: 774095 - protein, 342 aa, Homo sapiens; identical to SEQ ID NO: 774085

SEQ ID NO: 774096 - protein, 342 aa, Homo sapiens; identical to SEQ ID NO: 774085

SEQ ID NO: 774097 - protein, 342 aa, Homo sapiens; identical to SEQ ID NO: 774085

SEQ ID NO: 774098 - protein, 306 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAGNHGGEKEIWEGWRKSVLLAP

SEQ ID NO: 774099 - protein, 682 aa, Homo sapiens
GAGAETVGGGGRGRCEARRGCVRGAGGGGCQSRLSLRRGTSAASSSRRGPARPGSAASDAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHLRRL

SEQ ID NO: 774100 - protein, 679 aa, Homo sapiens
GAGAETVGGGGRGRCEARRGCVRGAGGGGCQSRLSLRRGTSAASSSRRGPARPGSAASDAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774101 - protein, 666 aa, Homo sapiens
LSPHLCQPAPPPLQLSDNPWADSALISSLLASRPTLHPFPFFLPADAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774102 - protein, 795 aa, Homo sapiens
GAGAETVGGGGRGRCEARRGCVRGAGGGGCQSRLSLRRGTSAASSSRRGPARPGSAASDAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVTSGSAGVKLAPLGPNGPSPPCRDPGMRASPGPFPEVPEVLPEGSDPRVVSRADRKATMGLFSLSLHPSPDLVLSLSMVPGSVTVHLSGSLSVHLFLSTCLSVPVAPSHPPLPHPQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774103 - protein, 867 aa, Homo sapiens
GAGAETVGGGGRGRCEARRGCVRGAGGGGCQSRLSLRRGTSAASSSRRGPARPGSAASDAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVTSGSAGVKLAPLGPNGPSPPCRDPGMRASPGPFPEVPEVLPEGSDPRVVSRADRKATMGLFSLSLHPSPDLVLSLSMVPGSVTVHLSGSLSVHLFLSTCLSVPVAPSHPPLPHPQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHRGPSSNEWSDRGEGPHSGISDLVLPSSSNRETHTGQGRRRGPCLPPFSGTPTPLLFEWKWKSQYSFIKLSFGT

SEQ ID NO: 774104 - protein, 744 aa, Homo sapiens
LQEAGAARYCRMHLGRGDPAAAALSTRVNSWRAGRGAICAGQAPRSRLGAPEPGRSHLPAAWPMNARPGDVMPRPDPGDESPKSPVREPAQTHPRGFQKFPLPPRSAPRPAALRVLPRCPAFSDAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774105 - protein, 634 aa, Homo sapiens
CHCALSSVGVWHWNAACPAAMRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774106 - protein, 278 aa, Homo sapiens
KIRTIQRRLAWPLRDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 774107 - protein, 3418 aa, Homo sapiens [sequence omitted]

SEQ ID NO: 774108 - protein, 3460 aa, Homo sapiens
MPIGSKERPTFFEIFKTRCNKADLGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVAHQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETSYKGKKIPKDQKSELINCSAQFEANAFEAPLTFANADSGLLHSSVKRSCSQNDSEEPTLSLTSSFGTILRKCSRNETCSNNTVISQDLDYKEAKCNKEKLQLFITPEADSLSCLQEGQCENDPKSKKVSDIKEEVLAAACHPVQHSKVEYSDTDFQSQKSLLYDHENASTLILTPTSKDVLSNLVMISRGKESYKMSDKLKGNNYESDVELTKNIPMEKNQDVCALNENYKNVELLPPEKYMRVASPSRKVQFNQNTNLRVIQKNQEETTSISKITVNPDSEELFSDNENNFVFQVANERNNLALGNTKELHETDLTCVNEPIFKNSTMVLYGDTGDKQATQVSIKKDLVYVLAEENKNSVKQHIKMTLGQDLKSDISLNIDKIPEKNNDYMNKWAGLLGPISNHSFGGSFRTASNKEIKLSEHNIKKSKMFFKDIEEQYPTSLACVEIVNTLALDNQKKLSKPQSINTVSAHLQSSVVVSDCKNSHITPQMLFSKQDFNSNHNLTPSQKAEITELSTILEESGSQFEFTQFRKPSYILQKSTFEVPENQMTILKTTSEECRDADLHVIMNAPSIGQVDSSKQFEGTVEIKRKFAGLLKNDCNKSASGYLTDENEVGFRGFYSAHGTKLNVSTEALQKAVKLFSDIENISEETSAEVHPISLSSSKCHDSVVSMFKIENHNDKTVSEKNNKCQLILQNNIEMTTGTFVEEITENYKRNTENEDNKYTAASRNSHNLEFDGSDSSKNDTVCIHKDETDLLFTDQHNICLKLSGQFMKEGNTQIKEDLSDLTFLEVAKAQEACHGNTSNKEQLTATKTEQNIKDFETSDTFFQTASGKNISVAKESFNKIVNFFDQKPEELHNFSLNSELHSDIRKNKMDILSYEETDIVKHKILKESVPVGTGNQLVTFQGQPERDEKIKEPTLLGFHTASGKKVKIAKESLDKVKNLFDEKEQGTSEITSFSHQWAKTLKYREACKDLELACETIEITAAPKCKEMQNSLNNDKNLVSIETVVPPKLLSDNLCRQTENLKTSKSIFLKVKVHENVEKETAKSPATCYTNQSPYSVIENSALAFYTSCSRKTSVSQTSLLEAKKWLREGIFDGQPERINTADYVGNYLYENNSNSTIAENDKNHLSEKQDTYLSNSSMSNSYSYHSDEVYNDSGYLSKNKLDSGIEPVLKNVEDQKNTSFSKVISNVKDANAYPQTVNEDICVEELVTSSSPCKNKNAAIKLSISNSNNFEVGPPAFRIASGKIVCVSHETIKKVKDIFTDSFSKVIKENNENKSKICQTKIMAGCYEALDDSEDILHNSLDNDECSTHSHKVFADIQSEEILQHNQNMSGLEKVSKISPCDVSLETSDICKCSIGKLHKSVSSANTCGIFSTASGKSVQVSDASLQNARQVFSEIEDSTKQVFSKVLFKSNEHSDQLTREENTAIRTPEHLISQKGFSYNVVNSSAFSGFSTASGKQVSILESSLHKVKGVLEEFDLIRTEHSLHYSPTSRQNVSKILPRVDKRNPEHCVNSEMEKTCSKEFKLSNNLNVEGGSSENNHSIKVSPYLSQFQQDKQQLVLGTKVSLVENIHVLGKEQASPKNVKMEIGKTETFSDVPVKTNIEVCSTYSKDSENYFETEAVEIAKAFMEDDELTDSKLPSHATHSLFTCPENEEMVLSNSRIGKRRGEPLILVGEPSIKRNLLNEFDRIIENQEKSLKASKSTPDGTIKDRRLFMHHVSLEPITCVPFRTTKERQEIQNPNFTAPGQEFLSKSHLYEHLTLEKSSSNLAVSGHPFYQVSATRNEKMRHLITTGRPTKVFVPPFKTKSHFHRVEQCVRNINLEENRQKQNIDGHGSDDSKNKINDNEIHQFNKNNSNQAAAVTFTKCEEEPLDLITSLQNARDIQDMRIKKKQRQRVFPQPGSLYLAKTSTLPRISLKAAVGGQVPSACSHKQLYTYGVSKHCIKINSKNAESFQFHTEDYFGKESLWTGKGIQLADGGWLIPSNDGKAGKEEFYRALCDTPGVDPKLISRIWVYNHYRWIIWKLAAMECAFPKEFANRCLSPERVLLQLKYRYDTEIDRSRRSAIKKIMERDDTAAKTLVLCVSDIISLSANISETSSNKTSSADTQKVAIIELTDGWYAVKAQLDPPLLAVLKNGRLTVGQKIILHGAELVGSPDACTPLEAPESLMLKISANSTRPARWYTKLGFFPDPRPFPLPLSSLFSDGGNVGCVDVIIQRAYPIQWMEKTSSGLYIFRNEREEEKEAAKYVEAQQKRLEALFTKIQEEFEEHEENTTKPYLPSRALTRQQVRALQDGAELYEAVKNAADPAYLEGYFSEEQLRALNNHRQMLNDKKQAQIQLEIRKAMESAEQKEQGLSRDVTTVWKLRIVSYSKKEKDSVILSIWRPSSDLYSLLTEGKRYRIYHLATSKSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVERQSLALSPPGWSTIAQSRITAVSASWAQADSRALASQVAGTQNIDILCNEAENKLMHILHANDPKWSTPTKDCTSGPYTAQIIPGTGNKLLMSSPNCEIYYQSPLSLCMAKRKSVSTPVSAQMTSKSCKGEKEIDDQKNCKKRRALDFLSRLPLPPPVSPICTFVSPAAQKAFQPPRSCGTKYETPIKKKELNSPQMTPFKKFNEISLLESNSIADEELALINTQALLSGSTGEKQFISVSESTRTAPTSSEDYLRLKRRCTTSLIKEQESSQASTEECEKNKQDTITTKKYI

SEQ ID NO: 774109 - protein, 337 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 774110 - protein, 313 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKLVPVLSAKAAQASDLEKIHLDEKSFRWLHNEDQMAVEKLSDGIRKFAADAVKLERMLTERMFNAENGK

SEQ ID NO: 774111 - protein, 337 aa, Homo sapiens; identical to SEQ ID NO: 774109

SEQ ID NO: 774112 - protein, 337 aa, Homo sapiens; identical to SEQ ID NO: 774109

SEQ ID NO: 774113 - protein, 102 aa, Homo sapiens
WQRLVTLGSNHASKPGLSLTPSLPQDKQYKGEKNTLGSFRITCITDPMTKAAIEPQSRERRLGARSAAWLPAPRLVQKVLLLDIPCQDLETDGLFQKFFILR

SEQ ID NO: 774114 - protein, 80 aa, Homo sapiens
RDQISESGSWVDGSFSPCGGGSGMGRNQWGEVRHATNPRPIPWQLAEFSKEHSFSQSIRRLQVREAQLLRPHLTVVPPWE

SEQ ID NO: 774115 - protein, 315 aa, Homo sapiens
MPLKLRGKKKAKSKETAGLVEGEPTGAGGGSLSASRAPARRLVFHAQLAHGSATGRVEGFSSIQELYAQIAGAFEISPSEILYCTLNTPKIDMERLLGGQLGLEDFIFAHVKGIEKEVNVYKSEDSLGLTITDNGVGYAFIKRIKDGGVIDSVKTICVGDHIESINGENIVGWRHYDVAKKLKELKKEELFTMKLIEPKKAFEIELRSKAGKSSGEKIGCGRATLRLRSKGPATVEEMPSETKAKAIEKIDDVLELYMGIRDIDLATTMFEAGKDKVNPDEFAVALDETLGDFAFPDEFVFDVWGVIGDAKRRGL

SEQ ID NO: 774116 - protein, 315 aa, Homo sapiens; identical to SEQ ID NO: 774115

SEQ ID NO: 774117 - protein, 78 aa, Homo sapiens
TWCRTQLRAIEKIDDVLELYMGIRDIDLATTMFEAGKDKVNPDEFAVALDETLGDFAFPDEFVFDVWGVIGDAKRRGL

SEQ ID NO: 774118 - protein, 80 aa, Homo sapiens
SNRGVKGQDGAGAAPKHGENQRPQEWQTLDMLLEMGGQNDQRSGSLHLRGSRVTSFKGGNWGSWNLPCTPDASGALENLP

SEQ ID NO: 774119 - protein, 105 aa, Homo sapiens
MINVQGPFISEGLESPHLKVAWDTSYPAIRRPGLAQQLHPPLLFTHDTSLPTRHCWLTCDTPGSSDARQVLLVCVSRGLQRTRASRGHTHLCIWRKRSMRRNLLL

SEQ ID NO: 774120 - protein, 257 aa, Homo sapiens
MWTGSAGSWRPTPAFVPSFLGVSWPRRTRGLSHLCPGLTVAPFSGALLSPRLLPLQLLGSAPASPRASPIPGPSLARDPRGCLRQPSPLPGGSPLLSPAALPPAPGLGNLEDPEGGSGMCDTSRRLTSSLAGSTLHREPAAMLPLSCPCGAAERDAWAGWAVAAVGEALWAVLFPEKLQPQGAGAGPGLTEWDSRGGRVGVPYDVGHCCTLGRGPSAVMPKFQRSDCLGALRLPDPAGRPILGEGESGVGQKAHPDN

SEQ ID NO: 774121 - protein, 144 aa, Homo sapiens
AESATELQPFSETGTRDGSHAPDSLAPGLSYGIGPRAAGTYVFQKSVTFEDVAVYFTQAEWDGLSPAQRTLYRDVMLENYGNVASLGFPLLKPAVISQLEGGSELGGSSPLAAGTGLQGLQTVDIQTDNDLTKEMYERKRECII

SEQ ID NO: 774122 - protein, 65 aa, Homo sapiens
SEFKVSEEHDPSFLLGGHAVGSCHQVELVYRDRPKGWSHIPETTNTWWGVECPGSPADSGSPVFP

SEQ ID NO: 774123 - protein, 124 aa, Homo sapiens
PRTETKEILAHRGSPGGTAQETGEETRLGPPNLPLARKDFPNGKSHGDCCCQYRKFSLLSALKASHCTALALGSPEIAGEKKGSTGRFRHVEKECAWLYQLELGSEVELRRLVQGECSAKRRCC

SEQ ID NO: 774124 - protein, 108 aa, Homo sapiens
MLLSNGMEENLRTDPNGIIYMEWNGIIHGLNVIIIERNRMESSNGLKWNNHCTEWNGIIIGWKRMESSSNGNERSHHLMELHGIIIKWNRMESTSNGVKWNHDVEMRV

SEQ ID NO: 774125 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 774126 - protein, 638 aa, Homo sapiens; identical to SEQ ID NO: 774125

SEQ ID NO: 774127 - protein, 344 aa, Homo sapiens [sequence omitted]

SEQ ID NO: 774128 - protein, 134 aa, Homo sapiens
AAPARGCPAYRAWRFRARPGAGSESLLRVAVARRGAHKLSQVRWRRWAALGCKLGSPASSRGFGGAPLVPWPHGAEGRRPEPRSLTLAGPALPSPAPAGAPCAARVGVPGRPAGSFPPGGGGAGVWAQTGRRGP

SEQ ID NO: 774129 - protein, 110 aa, Homo sapiens
APVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEII

SEQ ID NO: 774130 - protein, 104 aa, Homo sapiens
PRDLLASASHQVTCFLAKISEALHSVKIPNMHKSVTKYSYFGFGSLHTFSYLVTHLLKVSVLTLPTGKAVGFPKLPGRCWDAEVPIWEVGGKHESQRAQSCLFL

SEQ ID NO: 774131 - protein, 126 aa, Homo sapiens
MGQSIPRLMEAGARTTKLSDWFAQDRESREHKLQQELSFRGQKKAAKLVGCRETRTQVHAISWVQRGNPAGQEQGSQGTRGQQMLKRTKVSGKKESDTYKKGHLQGEKPVPYSYTGPSSGPLTPVS

SEQ ID NO: 774132 - protein, 53 aa, Homo sapiens
VLPPKLKDNTAITSSHYKTIICVTGQLENTEEENQPPQSYPQNMSGFGPFSTV

SEQ ID NO: 774133 - protein, 544 aa, Homo sapiens
RGFASVALLNPSCRESDSTDGASVVVQPPQVNSSGAKGDSHSLVARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGACLHLNIRIGF

SEQ ID NO: 774134 - protein, 1650 aa, Homo sapiens
MDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 774135 - protein, 101 aa, Homo sapiens
LINCRVIGYPYYSIKWYKDALLLPDNHRQVVFENGTLKLTDVQKGMDEGEYLCSVLIQPQLSISQSVHVAVKGRPPSPARAPARLTTQDAWAFPQLGLRQQ

SEQ ID NO: 774136 - protein, 2195 aa, Homo sapiens
MAGCWHMDDTCLSATTGSKPVGDRDPSPLRQRSRVGAVWPGPPLLFLGLWGWGPSGLRARAALTTRGAAGGRGERPPSPAPRMTGAGEPRREEPPPQPSAGLRSRESGAPSAGGWERAERGRGAAARPATGPPPRRIGPLYGMWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 774137 - protein, 57 aa, Homo sapiens
PSKPQLKDATSKKLSQIDLPPSPNSVIFPKGCAPAFSQLTRPSPCSVPGPPAGIKAV

SEQ ID NO: 774138 - protein, 264 aa, Homo sapiens
LGPLPGRPQHHTHCKPGLFFIHHHRPGLNITAWGLVPSGGTSGLMRGDSPHYRSIFIRQYMQQWKFCETCSNPGAAGRTVPKPTLDPTARKWVQNCLARSHPCVNRPTTPRALPDLPSTSQPLPSPLPQPAGPTLAGGCSLLTSLARAMPSTSRKAYREMLQVTVIFEHEKLTQRTFWLRERSWGSRLLSWLCSAMPGRKMGTSSDPGWLRACREEPLEREPLWAGRTATGVSIYWYRGEEEKAGGPGDGPSKSVTPELLLSPQ

SEQ ID NO: 774139 - protein, 441 aa, Homo sapiens
CVLMAFLDHRGLRHSSAKVRSRTAYLFSRFVKSLNKQMNPFIEDILNRIQDLLELSPPENGHQSLLSSDDQLFIYETAGVLIVNSEYPAERKQALMRNLLTPLMEKFKILLEKLMLAQDEDRQASLADCLNHAVGFASPTSKAFSNKQTIKQCGCSEVCLDCLQTFLPALSCPLQKDILRSGVRTFLHRMVICLGEEVFPFIPAASERMLKDCEAEDLQEFILLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 774140 - protein, 441 aa, Homo sapiens; identical to SEQ ID NO: 774139

SEQ ID NO: 774141 - protein, 441 aa, Homo sapiens; identical to SEQ ID NO: 774139

SEQ ID NO: 774142 - protein, 103 aa, Homo sapiens
MPACFKRKPFKRRQGPKRTSIQSEREEVSSWRRADDRKDDRVEERDPPRRVPPPALSRDRERDRDREREGEKEKASWRAEKDRESLRRTKNETDEDGWTTVRR

SEQ ID NO: 774143 - protein, 342 aa, Homo sapiens
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEI

SEQ ID NO: 774144 - protein, 342 aa, Homo sapiens; identical to SEQ ID NO: 774143

SEQ ID NO: 774145 - protein, 342 aa, Homo sapiens; identical to SEQ ID NO: 774143

SEQ ID NO: 774146 - protein, 77 aa, Homo sapiens
RQMPSPMPGLHYLVSRTRTRKRRGNWQPARRGPGPHISPFAHSPSFPTHSLEGRLLHPALAWPQGEPPPPPIPPPET

SEQ ID NO: 774147 - protein, 107 aa, Homo sapiens
MSFRIYCILFLDLSARTRATLLLEATPTAHILSSSFHSLQTSRIVSYNCLFTHFPPPSQFRLQAREDNFKVFLQTDPLAAPEVFYGPVSRVNPRRRGWISPGYGWGI

SEQ ID NO: 774148 - protein, 116 aa, Homo sapiens
GLCSSVSVGPSHLNASDFLPPYHFLFLCSVHRSPWWELRRRQAKRGRRGESRGEAERVAGVGICRAGTAPGPRKALGGEGRPGRPPKQWPSPLERHCVKAPGIRKKYLNNNNRKPT

SEQ ID NO: 774149 - protein, 117 aa, Homo sapiens
VKGLRLNSKKANSKGPERLCLRRSHTDSQQVNEELFGIINHQGEANRSHREVSFHAVQLAIIKKTNVTGVDENAEKRHLARCEGERASISVATTQTIWRCLQKSKMELLAQGGGSHL

SEQ ID NO: 774150 - protein, 133 aa, Homo sapiens
GGEGGRERRPAHSFRKCNNKGPSWKQRAAFTRQSNLPPACALMLDFSASRTCQNFQSLLAQMPSFCMPFRRASVMPAEERMLFVQCFLPFRCLFYPEAPSFWKSLLLAFALISSVVRRKEVPDLSHDLKFDHV

SEQ ID NO: 774151 - protein, 113 aa, Homo sapiens
WESFLNTAESFLPSPIRTFAILASLPGLFFKRLHLSCPLKIMFSEKSFMTTTPSRGRSYFSFEAFLFFLSWDLAQFELSSVYDALLGFVDPARMSFIKAGTTSLRSHCSVSSP

SEQ ID NO: 774152 - protein, 113 aa, Homo sapiens
SGGAEKRCPRRRRLALSGCPSPDPDIQASAPFPERVLCFIKNEIRKRERKIFLMESGNVKSGTCEEEKILQSWSSTSAEDIWNALVQHEKEEISDEARHPVSGRTDIRAQASS

SEQ ID NO: 774153 - protein, 202 aa, Homo sapiens
MDPSADTWDLSSPLISLWINRFYIYLGFAVSISLWICVQIVIEMQGFATVLAEAVTSLDLPVAIINLKEYDPDDHLIEEVTSKNVCVFLVATYTDGLPTESAEWFCKWLEEASIDFRFGKTYLKGMRDAVFGLGNSAYASHFNKVGKNVDKWLWMLGVHRVMSRGEGDCDVVKSKHGSIEANFRAWKTKFISQLQALQKGER

SEQ ID NO: 774154 - protein, 192 aa, Homo sapiens
HPHRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQS

SEQ ID NO: 774155 - protein, 759 aa, Homo sapiens
AGGGSPPSPGSSRLRRERCIVGRGAGVGKMAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQGVRMDPHRQGSNNIVPNSINDTINSTKTEQPATKETSMKNKPDFKALTDSNAILYPSLASNASNHNSHVVDMLRKNEGPHTSANVGVLSSCLDVRTVIPETSVSSTVSSTQTMVTQQTIKTESSSTNGAVVKDETSLTTFSTKSEVDETYALPATKISRVETHATATPFSKETPSNPVATVKAGERQWCDVGIFKNNTALVSQFYLLPKGKQSISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 774156 - protein, 821 aa, Homo sapiens
AGGGSPPSPGSSRLRRERCIVGRGAGVGKMAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQGVRMDPHRQGSNNIVPNSINDTINSTKTEQPATKETSMKNKPDFKALTDSNAILYPSLASNASNHNSHVVDMLRKNEGPHTSANVGVLSSCLDVRTVIPETSVSSTVSSTQTMVTQQTIKTESSSTNGAVVKDETSLTTFSTKSEVDETYALPATKISRVETHATATPFSKETPSNPVATVKAGERQWCDVGIFKNNTALVSQFYLLPKGKQSISKVGNADVPDYSLLKKQDLVPGTGYRFRVAAINGCGIGPFSKISEFKTCIPGFPGAPSAVRISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 774157 - protein, 563 aa, Homo sapiens [sequence omitted]

SEQ ID NO: 774158 - protein, 111 aa, Homo sapiens
LHLLGSSNSPASACQVAGIMGMSHHARLSFVVLVEIGFHHVGQAGLELLTSGDLPASASQSAWITGVNYCTWPVLSFIYRWDLTLLPRIVSNSGAQAVLLPWPPEVLRLQA

SEQ ID NO: 774159 - protein, 1374 aa, Homo sapiens
LVYTSNDSYIVHSGDLRKIHKAASRGQVRKLEKMTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 774160 - protein, 631 aa, Homo sapiens
MQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 774161 - protein, 626 aa, Homo sapiens
ARSRGSTRVLIGLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 774162 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 774163 - protein, 1532 aa, Homo sapiens; identical to SEQ ID NO: 774162

SEQ ID NO: 774164 - protein, 1532 aa, Homo sapiens; identical to SEQ ID NO: 774162

SEQ ID NO: 774165 - protein, 1532 aa, Homo sapiens; identical to SEQ ID NO: 774162

SEQ ID NO: 774166 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 774167 - protein, 1516 aa, Homo sapiens
MAPLLSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 774168 - protein, 1532 aa, Homo sapiens; identical to SEQ ID NO: 774162

SEQ ID NO: 774169 - protein, 1532 aa, Homo sapiens; identical to SEQ ID NO: 774162

SEQ ID NO: 774170 - protein, 1183 aa, Homo sapiens
MNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 774171 - protein, 1532 aa, Homo sapiens; identical to SEQ ID NO: 774162

SEQ ID NO: 774172 - protein, 1532 aa, Homo sapiens; identical to SEQ ID NO: 774162

SEQ ID NO: 774173 - protein, 78 aa, Homo sapiens
LSPFPTQPSTTTIPHTGTTTTATTPTYNYGHLLHNVQLQPHPTQLPPPPPPLTTTIIISHTTLNYNHTPQILGIILYD

SEQ ID NO: 774174 - protein, 161 aa, Homo sapiens
MHFQAGAQLLPVLVPSHLCLGLGHLTAQCGASPCFSLHLPVCWLLLSKHRLGLWGRQGCTGWPPPSRSGRQHWGEKAWKGKCEGQMLSRLCTTASQYKEHSFSIHSACRICHIPRAPCRMVACSCGPCCLGGWSRMPELKQSFCLSLSKCWDYRYEAPCQA

SEQ ID NO: 774175 - protein, 124 aa, Homo sapiens
WDSPVAAGVGQLDGRITAASCMHSGSGLRCLLHESTLSPVGHMDHGVVTSVFRGVQGRICCAPKGLGSRTHTTTLLLYSINQSKPRDQPRFKEVDRPHHVMSGTAMSHCKGVGPGSTIHWESEL

SEQ ID NO: 774176 - protein, 113 aa, Homo sapiens
DTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRY

SEQ ID NO: 774177 - protein, 88 aa, Homo sapiens
PKQPTKPQPYRLYWALPFGQLAGHSPKAEHSILSLFKPTSSSDHNGNQSPQTTMQRRIHGNLKRKDTEMMLQWLQQEKLFASRYLKYT

SEQ ID NO: 774178 - protein, 88 aa, Homo sapiens; identical to SEQ ID NO: 774177

SEQ ID NO: 774179 - protein, 149 aa, Homo sapiens
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHVS

SEQ ID NO: 774180 - protein, 95 aa, Homo sapiens
LGLTNKLLFQESLQKTATRLSAFSWEEAKVQLSWVVLNLATSAMLPKFYPNEIKVTYLRCTGDEVGATSVLAPKISPLGLSSEKVGDDIAKATGD

SEQ ID NO: 774181 - protein, 108 aa, Homo sapiens
LLEMLTYEKKTYSSFSSRISLASEDHQPSSSFLNRILSHLLLPSRSKTELRKVRLVFGATKLSDISSVISFLSPETLHIVFPAGRSGRQTALNFPMHSIIKMHLFCQG

SEQ ID NO: 774182 - protein, 101 aa, Homo sapiens
GRTAPARPGKPLATFPAATATAPGDARPVPFTCSLSPGIIIVPLQTSPHPPSWRPRRCSNVLSHPPQRETNEPPPTFKREQNNTPLKKRGDPTSAGAGDHQ

SEQ ID NO: 774183 - protein, 75 aa, Homo sapiens
MTTFKEAMTFKDVAVVFTEEELGLLDLAQRKLYRDVMLENFRNLLSVGHQAFHRDTFHFLREEKIWMMKTAIQRE

SEQ ID NO: 774184 - protein, 103 aa, Homo sapiens
MEGHCLLGPVPSVPVPRRTLLQPFSLPPFLPLLAHPALPSPCKLGGCGKGTAWSQVSLCTHTHPLTCKLLDEQTPKAPSSDSAGIQVNSGRLAKDQPRAILQK

SEQ ID NO: 774185 - protein, 107 aa, Homo sapiens
MSEPDTSSGFSGSVENGTFLELFPTSLSTSVDPSSGHLSNVYIYVSIFLSLLAFLLLLLIIALQRLKNIISSSSSYPEYPSDAGSSFTNLEVCSISSQRSTFSNLSS

SEQ ID NO: 774186 - protein, 146 aa, Homo sapiens
APEMAEAGVRERGRGRGRALATFPTASEDRRGLPQLRGDTRVRGAGPGAGDCGRRGGARRPPSEPPNSRPAKAAGPCREDPTADGGEDAPGGVGTGSDSRATAASAGAPAPGKSSHKSLNLKLHSQRKGLQGRAPCAATACSFEAL

SEQ ID NO: 774187 - protein, 146 aa, Homo sapiens; identical to SEQ ID NO: 774186

SEQ ID NO: 774188 - protein, 113 aa, Homo sapiens
ITGTPVIASEPKAGGVCATLTYACITRGMTTRGGHSPQHARLPSRTQRKVPVLFGSLMKTNTEETNGKPKREGEMWLTICLWSWQPRAFGHPHQLFFKDGVSLCCPGCVCDLV

SEQ ID NO: 774189 - protein, 82 aa, Homo sapiens
MNNNIYYQSSNLVCLELEYSCLRHILEELEKSKKWITEKSLHSSSDDHMGPFYYRLHFCDTMELFMENINWNMFELRVHLLK

SEQ ID NO: 774190 - protein, 263 aa, Homo sapiens
PERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPL

SEQ ID NO: 774191 - protein, 262 aa, Homo sapiens
PERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWVSRNILICFKCG

SEQ ID NO: 774192 - protein, 999 aa, Homo sapiens
MPEDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 774193 - protein, 550 aa, Homo sapiens
MFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 774194 - protein, 573 aa, Homo sapiens
FTEIILSATCRMGWKAESLESATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 774195 - protein, 148 aa, Homo sapiens
GRVCDLVKQLPSTQDAQEPLEAAVGPQCLPLNPYGTCRVQGLSPSLRGEKACERATGSQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 774196 - protein, 64 aa, Homo sapiens
SNVRVTVTATAVIINLVVILILDEIYGAVAKWLTKIGTVSPRLLAVLGPLYVNACKAFGDKIKK

SEQ ID NO: 774197 - protein, 157 aa, Homo sapiens
MKQSSGTHRKFRVRSQVWSRARELTENAESGPRYGAELGNSQKIPSPVPGVEQSSGTHRKFRVRSQVWSRARELTENAESGPRYGAELGNSQKIPSPVPGMEQSSGTHRKCRVPSQVWSKAQELIELLLPFPFPATGTLFPQHTQVGKEFKNRMPSC

SEQ ID NO: 774198 - protein, 322 aa, Homo sapiens
MGTHQRHGIHIQINKSDRGRYLEGKWRHTGTRTPEINRKTSNRAGPRSRQMSNGGRRSTTRGQPDRRLQRMSRRQQKRRSTGNESKSGTRACRQRPTAKEVPPLMSQHTTQEDMTSTLSNTTHTAQTGHHSRGRTQAAAGQQKQSEQHIASSDTAGLTTEPRSTSIPRPEREHGLHAQRSARTHQQAKDQLDNQHHGCHTHHHVGDHKTPEKRWKTERDQQTHSKDTNKAAQHQSSRKRQKTTEQQRSHTHDHKSTTLTNNGHTTTNHRNVTRAHHPDAETHSNTHQAAQTTREAHDGTGQATQTQHNTTTANANTHTTSSH

SEQ ID NO: 774199 - protein, 122 aa, Homo sapiens
MDQLPGGPQPSQHSKRSRCTWGSQQGRGEGSLTQALMGRGNPCRVWGQYAGRRGGESQAARPARQSWGDWRRAVSACGQRPPRTWTDAPTIVPAVRLWKGLVWWDEARPWKLEVKGAVGGQV

SEQ ID NO: 774200 - protein, 127 aa, Homo sapiens
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGL

SEQ ID NO: 774201 - protein, 182 aa, Homo sapiens
NGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQSENFKKEAATALSLKRRFQPRGSCSQDTEAKRNVTEPQLHRPAL

SEQ ID NO: 774202 - protein, 37 aa, Homo sapiens
GGGSARSPGSCPPPGGAGRTPQSYRLLRLQRGRRVAS

SEQ ID NO: 774203 - protein, 119 aa, Homo sapiens
RWFFSPRVQSLSSLAGKPFTCTFLTVLQGSLSCDLTSLYKPQETACRARLLAMSIPLNLPLLGLPYSLRHNIIEIRPVTSPTVASKCSSERKSHTSLTFHQKLEMLKLNEEGMSKAETG

SEQ ID NO: 774204 - protein, 124 aa, Homo sapiens
MPEANYLLSVSWGYIKFKHGCLIGSSPISLNMSRSGNQVSRVYIKHILRYSNMTLAQLPSSNSARHHGRHHAQRPTVLTNQGESNKLRMPQTLTLTYIPRHPKVGQSTTSTPRQMSSARNQHDA

SEQ ID NO: 774205 - protein, 51 aa, Homo sapiens
MQGAAARSLSKWEKWDVRPILKYSKKLPFESGFGFCMSLGQNEDQWVQFVK

SEQ ID NO: 774206 - protein, 67 aa, Homo sapiens
SEVDVLGMWRRWPWSSYVRDCDLGDTIPRYTLKEKLAVPICLLQIISQIQENWRDQPVLVKIITRNL

SEQ ID NO: 774207 - protein, 152 aa, Homo sapiens
MKKEELKQHDGFRSSWKETTNTNIFETRYVTSYYRFSETEALLVWLLCSLQQRRNHISHSEGPLSTTAVWHQNGGCNTSVENGWISKLVSGNLSPIDAEDNYTCTYVGPGMRIYPTFSTSMSVLQSLQPVAWQQCLQGQRKQFSLQTLLQDH

SEQ ID NO: 774208 - protein, 152 aa, Homo sapiens; identical to SEQ ID NO: 774207

SEQ ID NO: 774209 - protein, 152 aa, Homo sapiens; identical to SEQ ID NO: 774207

SEQ ID NO: 774210 - protein, 222 aa, Homo sapiens
FTVCQIGLSEVFRYVKERQTKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGPLVGHNMMMDLLHLHEKFFRPLPESYDQFKQNIHSLFPVLIDTKSVTKDIWKEMNFPRVSNLSEVYEVLNR

SEQ ID NO: 774211 - protein, 187 aa, Homo sapiens
GAPAHRFLHACCQLSWEQGLPLPMCPFIFICTACGSCSVCTCGPCFLVSSPVSWLLVVSGLCGRSLRGTADSVWVFVLVVSYPGWIQTPALSASLVRAAADISEQLCPAFRHLLCSVETSLQGGAQAFQGSASLGPKFSDSACCGPSFPRSHPWLGSSTGGPNFILWLPEPAALCPVLCLCPAHGGS

SEQ ID NO: 774212 - protein, 41 aa, Homo sapiens
YLNQGSLCVPLFLASSLFPWTVIVYGDTSSTHLNPASIVGG

SEQ ID NO: 774213 - protein, 109 aa, Homo sapiens
WVLLKEFRFMYRQRYGWELEFMFKREPEHKSLKTLKPNNVTQNKNPLPKEKFKPAAEICMSNKKQMLVTKTVGIMSLGYVRGLHSSPSQHKSGDLEEKKWFHGPGPGPC

SEQ ID NO: 774214 - protein, 116 aa, Homo sapiens
MDNNSWFLLTRKISYSFLSRSYSAAAYSSSGTDEPVDLKLAPSSPPAPTPRGSDPGPAPAAAPAPRRNELRSRRALGFTSTGISQASPPPAPYVSSITSPPAGLTSDEAVPMASVA

SEQ ID NO: 774215 - protein, 54 aa, Homo sapiens
MSSPGIDGDPKPPCLPRNGLVKLPGQPNGLGAASITKGTPATKNRPCQPPPPPT

SEQ ID NO: 774216 - protein, 165 aa, Homo sapiens
GGARGGRGEEEAPAWFPAKRPYLSGHSLSLPGGRLGAADPLPPGSSFPCAAEGARPGRDAGRRARPGPAGQSSTPAAPARRRPCRAPHDGRSPGGQRGMSQEPGPRACQEDVEPGHRRRPQASMLASKRSGEAAGPAQRPGCGQHHQGHASHQEPPLPATTPTHP

SEQ ID NO: 774217 - protein, 52 aa, Homo sapiens
MRERGQDSLAGLVLYVGLFGHPGMLHRAKYSRFRNESITSLDEGSSGGSVGN

SEQ ID NO: 774218 - protein, 46 aa, Homo sapiens
GDARVAGWLTPLIVERDGEAPRTAGIRMEGGNRSEKSVEGCEGGGS

SEQ ID NO: 774219 - protein, 123 aa, Homo sapiens
LQVRPRGPRAGPRQEVGEGESQGGGKTFLRVLPKGARRERDLGKVQSASHGEGRAVQSGREASKLDTAPLWEAASKMELADVPWFVHLTMDTRKDFEKKSLKKNFFNAIPKLLTNAILWTSES

SEQ ID NO: 774220 - protein, 105 aa, Homo sapiens
CSGMTGQSQETQIGREPTSGPVAAFPSALPTKAKAGQPGRGCCRLTPLSLFVSCTCAHTTPYVASTAVSRREDVALSYIVQLCAFLERAVINVVFKFPTPSSPQQ

SEQ ID NO: 774221 - protein, 74 aa, Homo sapiens
TLSQSGSPSRGAAERLERRGWVLVETGGRGACPLVGVAARWAGWLLPPGDQGPGDFVPGPGSLSFRGHSEETAR

SEQ ID NO: 774222 - protein, 73 aa, Homo sapiens
CEITQVGAGRSEPSGQCGVRQQMSVTGQCRDSDGRGSHNMGSLRSAAESEWSETDSTWDGTQYSSPRNSCLKI

SEQ ID NO: 774223 - protein, 214 aa, Homo sapiens
AARHLATDGVGLADLVPLVTSAHGDNGELGQDDGPVDGSGHLLGALNTQTDVTVVARNGHKRLEPGSLAGSGLLLHRHNLQNLGLERGPPGKNNDLRFRDGQGEETDLLQGSDLHVLDQAAQLADGHPLLILGLASASSVASAPAWSTAVTPASDATAETSTEATMVPHPRAPGPPGLPPQPNAGCAGVIRHLVFSRRRSYMWNILTQQIVRTC

SEQ ID NO: 774224 - protein, 236 aa, Homo sapiens
MDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNS

SEQ ID NO: 774225 - protein, 85 aa, Homo sapiens
EFGVGKVQMNFLHLLSSEATHIITIHCLNTPRWTSTQTSGPGLPIGFKGWNGQIFKVNTLLEPKVLSDDCKIQDGSWHKATFLFH

SEQ ID NO: 774226 - protein, 45 aa, Homo sapiens
SEGKLVSRPRALLHGLRGHRALSLCPSPAQSPRSASPPGPAPQHP

SEQ ID NO: 774227 - protein, 365 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLGMHKKSMGMIRKPGSEDKLAGLWGSDHFKEGSSQSESGSQRGSDKVSPENGLEDVAIDLSSSARQETKKVHPGAGAQGGSNSTALEGPQPGKVGAT

SEQ ID NO: 774228 - protein, 239 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVSGVPFLRSKDTTENVSFPHSVSQSAVPSL

SEQ ID NO: 774229 - protein, 280 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLEGETLGCREMK

SEQ ID NO: 774230 - protein, 153 aa, Homo sapiens
CLLGSSDSPASASRVTGITGARHHSRLIFVFLVEIGFHHLDQAGLGPLSSSDPPALASQSAGIIGMNHHVWPHISICWEGSSREELRLLVASASTLERRPCTMQKTPPFPPYPISFLASAQRPVWGGSSSCPSADLWTSDGMGRGPLQVIPLR

SEQ ID NO: 774231 - protein, 789 aa, Homo sapiens
AGGARLRPARGRPPRLLPPRPGPCRPPPVPAPTVNERRAPPRAGWERRSDAGLSRGARPAEMYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEEVSVRATVLGQPHLL

SEQ ID NO: 774232 - protein, 840 aa, Homo sapiens
PRLSQNLDGVVIELLFRQSKISEVLGGSGYNSDRLCLPYIPQLTDEDRLSKRRSIGENIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRAPPSPSGTLMVLRSARTIHP

SEQ ID NO: 774233 - protein, 81 aa, Homo sapiens
SSVLCSRSRGGLRRAMVSNLIVQQERRAGLGTHLPSVLCKAGQAGSRMRGSHGLTMAGGLGMPSSEKHGGSPLSCVSLLPP

SEQ ID NO: 774234 - protein, 107 aa, Homo sapiens
ALAPTFPGPDQEALLTVFPILIPGVCGCCGALRPRYKRLVDNIFPEDPEVGHVSGRHRGSHGPGRASDGGSLEARPPAGWGRQGLSGSLGTEPSQRNWNLGYSHGQW

SEQ ID NO: 774235 - protein, 110 aa, Homo sapiens
MHHASHASHASIITACALKSCRRCSRVSVNSFHTWALCRFPCWLSHMHTGGWHAALHLLLLGAQKPLSVVVFHLGIIEPSWEVPGPENLCCIISPPRGNSQSKIFTENRT

SEQ ID NO: 774236 - protein, 119 aa, Homo sapiens
TFFLHLHRVFPTRNKQVQGLSSEHNGEYSHIARMVKALRRDGTTWTAWQLGPRTKLWGAPAFRGRRGDPASGTHRGGMARDPGGKPGGMLFLSSEDAAFKVPSWEQKPGPYQTPSLPAH

SEQ ID NO: 774237 - protein, 56 aa, Homo sapiens
PPPSARAEPSLIPEPEGDWDRENGDGGRPRRRRTRARNPGGPARSRPRPAGCGTLS

SEQ ID NO: 774238 - protein, 111 aa, Homo sapiens
MLSLPPTLSPERPQRVFFPSSCPCVLIVQLPLISENMRCLVFCSCPGLLRIMASSSIHVPAKDMILFLFMAAKILLLGDLLAFYSGLEFPLKLVFLGYIAEGWDWLDSTLL

SEQ ID NO: 774239 - protein, 107 aa, Homo sapiens
MSALTLLYHCYTLCSKTLNLKGCFQSCQVVSLPRPVSIYDRPKEDHLQLESSHLGDCVLPGWAICTGVRFISLKGKPFESFEYQHQEEQYKLEKLGVSPERELNKHS

SEQ ID NO: 774240 - protein, 72 aa, Homo sapiens
LVLITPAPFCFSVSCLFQKSVELKGLNDSSLPSVTGKLHGRNRILTQTRCGVPSGNASYSQWASYSCGPSSL

SEQ ID NO: 774241 - protein, 237 aa, Homo sapiens
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNHGDLP

SEQ ID NO: 774242 - protein, 120 aa, Homo sapiens
QDGGARTNEAAVEDRLATAEKMAVDQDVVGQVSVSSWIACGSPRPTPGQPFGLMCPVNSLGAEDMPINGRDCCMFRRVICVPSTQSPLLGLSCKIMAQSYNQGIDSETSPHLIQILQLYL

SEQ ID NO: 774243 - protein, 179 aa, Homo sapiens
REFTAGAGAQAWRAAGPEPCPSGRQLRPERSAGGPAVLGDPVHPPQPLAWVLSPSLPGPAGPAAAPSAGSAKPTPTRNPSWPTSAPGSPGSRSRLSLHNSLRAEGAGSGLGQPRKGLPQCSGGLKGSSSANKVGAQAEEAPRASEGCEDCQNAVTSHQESKYYQRHRGPELVLQLGKNT

SEQ ID NO: 774244 - protein, 256 aa, Homo sapiens
PVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTK

SEQ ID NO: 774245 - protein, 158 aa, Homo sapiens
LTGLLGELRMLGTEHGARHVAHTVLWDGVSVAGGNEEVLGVVAAGLCSRSDSGGREELGLHSQGQRGIKVSEEEVSCSKGHFQKINQQDDIGWTGMVERDWKVRPNVRVTAGPARGAKDTFKGPGQRSRAEEARVSRNRRGHMNTRGQVERRTQNSLE

SEQ ID NO: 774246 - protein, 100 aa, Homo sapiens
DLPFNPAYGFISQKEINPSTKNTYGHHSAIHSSKDRSTWLPINSGLDKENVVHINHGVLGSHKKNKIMSFAASHMDAAGSHNLSKLRTENQVLHVLTNGS

SEQ ID NO: 774247 - protein, 746 aa, Homo sapiens
PAAAAAAPLRTARRRLAMDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLACEGAPFTSVPQFPQL

SEQ ID NO: 774248 - protein, 906 aa, Homo sapiens
PAAAAAAPLRTARRRLAMDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 774249 - protein, 256 aa, Homo sapiens
PPGKETLPFRSDGIPALWRGPLVCVSLSFWGVDGAWDPAGNQLKTFSLEALGPEDFAWGIGPAMAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKDGVSLCCQAGVQWRNLGSLQPSPARFKRFSCLSLLRSWDYRIIQPESQSPSRRAENLSGISSIEPRSNRVSTVWLHDGGNIQPKRVLGLWM

SEQ ID NO: 774250 - protein, 655 aa, Homo sapiens
GAGVRAVSGARGYLALWRGPLVCVSLSFWGVDGAWDPAGNQLKTFSLEALGPEDFAWGIGPAMAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLGELQ

SEQ ID NO: 774251 - protein, 659 aa, Homo sapiens
GAGVRAVSGARGYLALWRGPLVCVSLSFWGVDGAWDPAGNQLKTFSLEALGPEDFAWGIGPAMAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLPRHRIHGH

SEQ ID NO: 774252 - protein, 596 aa, Homo sapiens
GAGVRAVSGARGYLALWRGPLVCVSLSFWGVDGAWDPAGNQLKTFSLEALGPEDFAWGIGPAMAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETVGHCPALRPTLAHISPCGCLAPSPLSLALAPGLGPHPLDPRLPGLGDQSLPWRSLQGAPLLPGAPV

SEQ ID NO: 774253 - protein, 655 aa, Homo sapiens; identical to SEQ ID NO: 774250

SEQ ID NO: 774254 - protein, 663 aa, Homo sapiens
AGTGPRSYDGKETLPSCSDGIPALWRGPLVCVSLSFWGVDGAWDPAGNQLKTFSLEALGPEDFAWGIGPAMAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLGELQ

SEQ ID NO: 774255 - protein, 131 aa, Homo sapiens
FFFLKQVTLPSLGPILGGKNQHIPELSKSFELQVHIQGSHSSACSQGTATANPAEEASLGTAQAARCTHFPEGSPFFRKQLFQASEQGLGIRVVGWQLTACSVEPGANSDPKASRGPVAGPSAQQDTHARG

SEQ ID NO: 774256 - protein, 138 aa, Homo sapiens
LWQGYGRDVVMSRTWRAPRFSPECTPLGPLCSPDLEGRDRFPDEEEGEGGPEWGQPVYKATGDACVTPALLLLTGYSSRRVQSPSSKSNDTLSGISSIEPSKHSGSSHSVASVSSRCQGSRAPGPGLPLLRTLPSASL

SEQ ID NO: 774257 - protein, 134 aa, Homo sapiens
MIAARGLAPSWPPAHMHRVTRHLCSGTSSSSPRGGKSIHCCDPSSSPNRKATRWAPVPAWPLEVTAKNNVGSQKQRHYAWPHWGQAGEIRDTQWGEDDAQTQPWGARAGGRALTSLSHSLAQAAPSVGRVPPSL

SEQ ID NO: 774258 - protein, 40 aa, Homo sapiens
EIAPLHSSLGDKSETPSQRKRKRETVKGLQHQANAQSRKL

SEQ ID NO: 774259 - protein, 113 aa, Homo sapiens [sequence omitted]

SEQ ID NO: 774260 - protein, 103 aa, Homo sapiens
GNEERHSSKTIPVNSTFFSWRFGLGQQERVLELQAWEDDVTEATEGIWLDVDYEVSSGLSISHLLEVKLISWSLKMGSETLCIQGSASESLVLNLHTSKSDQT

SEQ ID NO: 774261 - protein, 50 aa, Homo sapiens
MTSNWSLPLQKPLERKASNSCPCVGAIVAQRSSPSKKREGPKARNPNQET

SEQ ID NO: 774262 - protein, 118 aa, Homo sapiens
GVHTFPAVLQSSGLYSLSSVVTVPSSSLGTQTYTCNVNHKPSNTKVDKRVEPKSCDKTHTCPPCPAPELLGGPSVFLFPPKPKDTLMISRTPEVTCVVVDVSHEDPEVKFNWYVDGVE

SEQ ID NO: 774263 - protein, 176 aa, Homo sapiens
MSRPLSDQEKRKQISVRGLAGVENVTELKKNFNRPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVPC

SEQ ID NO: 774264 - protein, 110 aa, Homo sapiens
MPVSNTGAQCLQCLCIVRVTLLHFPTNSSSPSETTSAWTLLSISLLTFWSKPFNKSLGSSKLSHIFLSSSEPSKLFQPLPVTHFQSCFHIFGYLYSSSPLYWYQLIVLVC

SEQ ID NO: 774265 - protein, 111 aa, Homo sapiens
PPRPANFVFLVEGVSPCWSGWSQTPDLKWSPDSASQSVEITGVSHCARPQWVLSAGCPDRVDLSGQGSCHGEGLVHAEPVERETRLEVFFFFLRRSLTLSPRVECSDEISA

SEQ ID NO: 774266 - protein, 78 aa, Homo sapiens
CQLPELEKPTYKERCHVSPGEPGPSVGLAGPSQCDPTSMGSLFPPAQPWGAGLPLEGNSFQRLKGLQGRVIPASQVYP

SEQ ID NO: 774267 - protein, 93 aa, Homo sapiens
IRYTDPLIKVNDTIQIDLETGKITDFIKFDTGHLCMVTGGANLGRIGVITNRERHPGSFDIVHMEDANGNSFATQLSNIFVIGKGNKLWISLP

SEQ ID NO: 774268 - protein, 105 aa, Homo sapiens
MPGSSKSEYLILSQTCPKNPINSSHLIKGVHWKCNMVFLSCCCLNLQVSELEERNFYFVEKIQENFGKRKERIHSPHPPKKPFIKQPLDAWQKTIYTTCSRKIPS

SEQ ID NO: 774269 - protein, 161 aa, Homo sapiens
SRAYNGNLSPSMGSTCSLGLPQWPHYPAPADHRPPNLLPSPSSLPRAGPAHPQAHLPSLRASQEGWGTRRDSREGPGQGPRVQLPSQLCLASSVCACKTRLCSRTSVCSPENWEHPILPSGSARASFSLLGGRAEARLGREQTGVSWVIFSGPHLLDHMET

SEQ ID NO: 774270 - protein, 414 aa, Homo sapiens
FQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 774271 - protein, 414 aa, Homo sapiens; identical to SEQ ID NO: 774270

SEQ ID NO: 774272 - protein, 156 aa, Homo sapiens
MNDTEKPADTPSEEEDFGDPRTYDPDFKGPVANRSCTDVLCCMIFLLCIIGYIVLGLVAWVHGDPRRAAYPTDSQGHFCGQKGTPNENKTISFYFNLLRCTSPSVLLNLQCPTTQICVSKCPEKFLTYVEMQLLYTKRTKATGKTTVSSVRPLLSL

SEQ ID NO: 774273 - protein, 114 aa, Homo sapiens
MIFLLCIIGYIVLGLVAWVHGDPRRAAYPTDSQGHFCGQKGTPNENKTISFYFNLLRCTSPSVLLNLQCPTTQICVSKCPEKFLTYVEMQLLYTKRTKATGKTTVSSVRPLLSL

SEQ ID NO: 774274 - protein, 101 aa, Homo sapiens
GICGCPRVQFSFTDWTWRVTRLGDLVKIMKLRNPWPGKAFSRSCGSRVYVSLPQVDCCMQGLQHMVFIIVFHCSWLCAWRGVELMHPHPWFSDSLKSGGRD

SEQ ID NO: 774275 - protein, 132 aa, Homo sapiens
MIEVYWSRCCKPYRKYGGICFWGGLGKLPVMAEGEGGAGVSHGESGGKSARWEVCHRISRELTHYRENSTKGIALSCSYKSTLKIQSLPTRPHFQRRGDSSTGDWWGDPNSSTLLLLFAICSLSHWPQVLLQ

SEQ ID NO: 774276 - protein, 462 aa, Homo sapiens
MRKEKTHINTVIIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLCLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 774277 - protein, 108 aa, Homo sapiens
GVRSNLLPNGPAPQAPRVGLLRGPSLTLEAPSSSPYQTPCPRQPTASPVSAMGPSKAVADTRTCQSLRCSGPEQLFQLPVWCGWHLFPRQFNNVSRGTVSNGCHLSVA

SEQ ID NO: 774278 - protein, 58 aa, Homo sapiens
LICSYNGDFNTPLSEMDRCSGQKTSKNIDEFNSAVKQLDIIDIYETTSSNNSTIHILL

SEQ ID NO: 774279 - protein, 44 aa, Homo sapiens
GPTRAGTALARKAAAFLLRELQAQSVPPGYSRPKVTGLGKRPQN

SEQ ID NO: 774280 - protein, 176 aa, Homo sapiens
MTSLPGLLCSSTYKVTARFQDIQNNQDQVTGSGHCNDRRPLTFPIPGTFNNTWEIQELDFGTFVSDDTRHSAQSSEFIGCHLRIYPCQVTKQCRLPHKWKTNKSNSSITCLGHIKTFFCTSTTTTTLWSSEFSTKLSKTSLKQPQVVCCGLVESKPSPLLSPRLSWGAAHRGEYPV

SEQ ID NO: 774281 - protein, 133 aa, Homo sapiens
SGAGSAAGGGASFGSSSEQLAACSPWQEGPSAPRCGQAAAAGDERRDFGGPGAPFPGLVFRIRKRGSRMSPGGGGSKENEAVAGGGGGRGRLRPVRRPPQPRRGGDDSYPIVGCLASELFLNLEDFKPQLRNP

SEQ ID NO: 774282 - protein, 459 aa, Homo sapiens
RYYEAVVIRAIAVESLNLDSAVVGSPSPLSLSLSLSVSGSLSARAHRAALLPPSLCGCAGVCVCGCVWGVGVPYALPPLPPPPAPPSFPSPPPPSPLPPPGPHRPSPPLPPLSLPLPEFSPLLSGQSMVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 774283 - protein, 567 aa, Homo sapiens
RYYEAVVIRAIAVESLNLDSAVVGSPSPLSLSLSLSVSGSLSARAHRAALLPPSLCGCAGVCVCGCVWGVGVPYALPPLPPPPAPPSFPSPPPPSPLPPPGPHRPSPPLPPLSLPLPEFSPLLSGQSMVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLVAGPAAWLQPQRPGKGRGVEMGLAERPLRAREAVTPGQSEKVSACPGRAEEGAGLAVGVLIALTKRGFRQGRECVLATRVPAAPGRLSPALHPCLPPQPCRQLGDPLEPRDREGRKALFAIWFLFLCVAKPREKSTSVRERKVNLGPYHKGKRPEATAQRACFPATLHVA

SEQ ID NO: 774284 - protein, 294 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774285 - protein, 140 aa, Homo sapiens [sequence omitted]

SEQ ID NO: 774286 - protein, 178 aa, Homo sapiens
MRETIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774287 - protein, 294 aa, Homo sapiens; identical to SEQ ID NO: 774284

SEQ ID NO: 774288 - protein, 294 aa, Homo sapiens; identical to SEQ ID NO: 774284

SEQ ID NO: 774289 - protein, 140 aa, Homo sapiens
QNLGSPSHAAYGKLRITAVEGLAWTLCTWQSRGCGSCQPRSSAGLTQLLPMQRFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774290 - protein, 251 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQITGVSD

SEQ ID NO: 774291 - protein, 255 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQGGQAVGSEKV

SEQ ID NO: 774292 - protein, 169 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEHHQYNWWCSLG

SEQ ID NO: 774293 - protein, 235 aa, Homo sapiens
EGTFKGFIFLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774294 - protein, 150 aa, Homo sapiens
MDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774295 - protein, 294 aa, Homo sapiens; identical to SEQ ID NO: 774284

SEQ ID NO: 774296 - protein, 294 aa, Homo sapiens; identical to SEQ ID NO: 774284

SEQ ID NO: 774297 - protein, 94 aa, Homo sapiens
RTRGSTHAFATRRIYVRGCTNAVIIWFMDNYTIMAGILLGILLPQFLGVLLTLLYITRVEDIIMEHSVTDGLLGPGAKPSVEAAGTGCCLCYPN

SEQ ID NO: 774298 - protein, 244 aa, Homo sapiens
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCNWGEGVCPSGQEGRASGEGQEGRAVHAATPMARLASSQPPRCLEPSCKGGCFLEPSFFT

SEQ ID NO: 774299 - protein, 185 aa, Homo sapiens
MLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPLWQDVPQKIMESTGVQNLLSGRVPGGTGEGQVPDLVKKEVQRILGHIQAPPRPFLLFSWALLRFLNCLFLNVQLHKGQMKMVQ

SEQ ID NO: 774300 - protein, 181 aa, Homo sapiens
MLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPLWQDVPQKIMESTGVQNLLSGRVPGGTGEGQVPDLVKKEVQRILGHIQAPPRPFLFMLLSQGLGVLRVAWDSRACSPAL

SEQ ID NO: 774301 - protein, 153 aa, Homo sapiens
NHPQLSAMIRGQDAEMLRYITNLEVKELRHPRTGCKFKFFFRRNPYFRNKLIVKEYEVRSSGRVVSLSTPIIWRRGHEPQSFIRRNQDLICSFFTWFSDHSLPESDKIAEIIKEDLWPNPLQYYLLREGVRRARRRPLREPVEIPRPFGFQSG

SEQ ID NO: 774302 - protein, 1464 aa, Homo sapiens
PDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVQQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAGPFPSTSRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 774303 - protein, 1468 aa, Homo sapiens
PDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVQQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAGPFPSTSRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGTKMSLSTSKQVAFHICHRNQRRDGVGSPLENASLPGPLHLSSLQCHNLSDLVLSMIL

SEQ ID NO: 774304 - protein, 103 aa, Homo sapiens
MAPELQLGFPKRHKRQVGKTPPQAGVGAGPEVLALPQGYGNHTQKWFSLFESSVLSQEQLIRGLLSEGGCKDEFYLLVQGPLTLFPSPVALPGYYRQYRQEPV

SEQ ID NO: 774305 - protein, 1499 aa, Homo sapiens
PDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVQQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAGPFPSTSRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVDERHKHMDPSRRAGGVFLSLASRLMEPPSSRKRPNAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 774306 - protein, 1467 aa, Homo sapiens
PDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVQQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAGPFPSTSRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGGVGDNMYDPL

SEQ ID NO: 774307 - protein, 1083 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 774308 - protein, 307 aa, Homo sapiens
MVSFLLGSWSVPRSCSLCVWTLGHPVPYDPTVAACPLICCPGTWVHRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 774309 - protein, 412 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGVADLTLRRPSAPKNL

SEQ ID NO: 774310 - protein, 295 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILVTVRTKTMYGKGRGQCQLLRK

SEQ ID NO: 774311 - protein, 191 aa, Homo sapiens
LSFHDGLRGGGFPTLAAEDRGQPGSVKDPKMAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774312 - protein, 191 aa, Homo sapiens; identical to SEQ ID NO: 774311

SEQ ID NO: 774313 - protein, 161 aa, Homo sapiens
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774314 - protein, 137 aa, Homo sapiens
MAGRKLALKTIDWVAFAEIIPQNQKAIASSLKSWNETLTSRLAALPENPPAIDWAYYKANVAKAGLVDDFEKKVKSCAEWVSLSKARIVEYEKEMEKMKNLIPFDQMTIEDLNEAFPETKLDKKKYPYWPHQPIENL

SEQ ID NO: 774315 - protein, 186 aa, Homo sapiens
ELRYPLHVPGAAEDRGQPGSVKDPKMAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774316 - protein, 176 aa, Homo sapiens
LQEFGTMSVSVKDPKMAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774317 - protein, 191 aa, Homo sapiens; identical to SEQ ID NO: 774311

SEQ ID NO: 774318 - protein, 191 aa, Homo sapiens; identical to SEQ ID NO: 774311

SEQ ID NO: 774319 - protein, 193 aa, Homo sapiens
LSFHDGLRGGGFPTLAAEDRGQPGSVKDPKMAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPSIEGTELESDHV

SEQ ID NO: 774320 - protein, 95 aa, Homo sapiens
ISDILNKAVRNKDGIRKITQVVFKYLIICLKALKANYGTQWLHQREVWLGAQVACPDHSVAEPCENRHSVGLRMRNLQKQPGAAILSWFSIWASL

SEQ ID NO: 774321 - protein, 161 aa, Homo sapiens; identical to SEQ ID NO: 774313

SEQ ID NO: 774322 - protein, 95 aa, Homo sapiens; identical to SEQ ID NO: 774320

SEQ ID NO: 774323 - protein, 137 aa, Homo sapiens; identical to SEQ ID NO: 774314

SEQ ID NO: 774324 - protein, 185 aa, Homo sapiens
VDTAATRQGAAEDRGQPGSVKDPKMAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774325 - protein, 145 aa, Homo sapiens
DPLNIVSQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 774326 - protein, 191 aa, Homo sapiens; identical to SEQ ID NO: 774311

SEQ ID NO: 774327 - protein, 191 aa, Homo sapiens; identical to SEQ ID NO: 774311

SEQ ID NO: 774328 - protein, 100 aa, Homo sapiens
TLPLFYGSIVRFFLYGDHDGEVYATGGEVQIAMEPQALYDEVRTVPIAKLDRTVAEKAVKKYVEDEMARLPDRLSVTWPEGDELLPNEVRPAGTPIGMFV

SEQ ID NO: 774329 - protein, 180 aa, Homo sapiens
PRLECNGVISAHCNLRLLGSSNSPASVSRVAGTTGARHHAWLIFVFLVETGFHHVGQAGLELLTSSDPPISASQSAGITGMSHHAYPDVVILLSPFNRQESTKWGSPLSKNSGSQAGLCHTDVHQAWAHLTPPALHAPVAPAKGLWPLLHGLEPVAEPQSSTEDNSKDGCAFRVFLCLRS

SEQ ID NO: 774330 - protein, 172 aa, Homo sapiens
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 774331 - protein, 259 aa, Homo sapiens
RGVGAPAPGGGTSALGSRASGRRLFPGTPPTPRTPAPPVPASPAPPARSCPEVSVPPPALARGSPGPPGTSARSSGPERPPHGLPLQMLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 774332 - protein, 259 aa, Homo sapiens; identical to SEQ ID NO: 774331

SEQ ID NO: 774333 - protein, 172 aa, Homo sapiens; identical to SEQ ID NO: 774330

SEQ ID NO: 774334 - protein, 154 aa, Homo sapiens
MDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 774335 - protein, 172 aa, Homo sapiens; identical to SEQ ID NO: 774330

SEQ ID NO: 774336 - protein, 43 aa, Homo sapiens
MPRAMEEQQTLKHNEGKTDSQVGRTFSVRHVHPFEVVDTPSNQ

SEQ ID NO: 774337 - protein, 68 aa, Homo sapiens
SLQALVTPPPPVRKKTFFKFINYKKSENEKIKMLNKLALRSSRSALARGSGESGASESPRAGDWATSA

SEQ ID NO: 774338 - protein, 119 aa, Homo sapiens
MLLLPHGSPTVYLESNPLWRLSCQLNPCTFRGWFWRAVLTPKHPSSLPGVKGLRFAPAPYAPDVIMHLGWAATSQLSLVPRRDRRLRDNELSEEPRNPGSEQLRRMRAAKWWRIWPGKR

SEQ ID NO: 774339 - protein, 153 aa, Homo sapiens
MTIHILILLLLLAFSAQGDLDTAARRGQHQVPQHRGHVCYLGVCRTHRLAEIIYWIRCLHQGALGEGQPRAPGPLQLWAPPVARGGSPARFPGFRPAARGLAQCPARWVTSGTARPLLGFSLPICMLELLLHISSPLTPAPETVFPSPSPGCD

SEQ ID NO: 774340 - protein, 78 aa, Homo sapiens
AYPFPSRFKVFADYEDYIKCQEKVSALYKNPREWTRMVIRNIATSGKFSSDRTIAQYAREIWGVEPSRQRLPAPDEAI

SEQ ID NO: 774341 - protein, 111 aa, Homo sapiens
ATNQQQQQQQKTKRTQRLRSSLALRRWLCKSQLASANFPASLLPVSLHPFSTPLGGRRVLDNNSLGITLPGCNRNCYNSEILCKHWPFCLECLLLSFLTACSYLSFKARKK

SEQ ID NO: 774342 - protein, 84 aa, Homo sapiens
RMFRVCAQGVGPGARVWVCVHVGVGLRACGCVYVCGGVCTRVGVCVCVDVCVRVDVCMWLCVCTCARVYVHVGICLCGYGCAHV

SEQ ID NO: 774343 - protein, 97 aa, Homo sapiens
HRLTQLIFVFLVETGFRHVGQAGLELLTSGDLPTSASENAGTTGVSHCTRPTPPLNTITVTISFSIGILGTHCDHSSYLLATVSNAAVNMGVHPTIP

SEQ ID NO: 774344 - protein, 84 aa, Homo sapiens
ISLSVSRAAVQVGGMDCKSQKSQATSTLQVATPHPAKHRFFLPTFPSAPTVHTIPYACPFGKLASRTASFLERQQEADGHSSTL

SEQ ID NO: 774345 - protein, 101 aa, Homo sapiens
MRDREDTCAPLRVALVQGAGREWGSARPGALETHGRSIPPGHSLHPPSELRNLPRALAFPPLGAEGGCTPQGSPLRPADSAEQSPSPVLATPIPSRPPALP

SEQ ID NO: 774346 - protein, 110 aa, Homo sapiens
QRPRRHTGASEARGKWAKGGGTTAAAAAAEGQGIERAVGGGSASQPRLLLLFLLLLQTREPQSSLSRREHPEGREAAAQPRAGQCPQPPWIATTRWWRRRWKVITPRKSQ

SEQ ID NO: 774347 - protein, 39 aa, Homo sapiens
MDSDDEMVEEAVEGTSISPGPGEEAQRAWSAEGVAGCEQ

SEQ ID NO: 774348 - protein, 117 aa, Homo sapiens
GRPVPPPPQPACRAPTARPESRGPSDSDGAGRGRGARKPLCTVSAGHKFVPRLPGAWALRENRAEGARRRGRGRRRRAQEWGKVRKEATAAPPGTRKVASASRPPALRRGCGGVGAG

SEQ ID NO: 774349 - protein, 104 aa, Homo sapiens
MPGNRRDAVRKATGCRSWKGKVGGSAASCLRAGHTRRGCPGQGGIWLILPVPCALGAAPPSAQRSPPACFLEAGLPSVPRLACPPPAPRGQGKGSRSGLPGEFP

SEQ ID NO: 774350 - protein, 278 aa, Homo sapiens
LRLGTRLGLNRPRKRTAVSTGEEPALSRSEKDDEDTWERAAAGLGRAGAGWRLCSSACCCLWELGASAEGLPADRDPLPRLPCPPCRGGRKMPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQRSLALSPGPLHSSLGDRARLRLKQKKMFLKSIAGPQGPWQKPNCNPFLKDRFPRGVVTQAPERGSHPVASTLA

SEQ ID NO: 774351 - protein, 122 aa, Homo sapiens
LRLGRGRVLIGRGTIRLRVRLSLLLAVTGGAAALSALSPPGENEPQCPPARSQPCPGQRKTTRIPGSGRRPGWAAPVRAGDSAPPLAAVSGNWVPALRGFQRTGTPFPGSPAHPAGEGGRCR

SEQ ID NO: 774352 - protein, 237 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 774353 - protein, 237 aa, Homo sapiens; identical to SEQ ID NO: 774352

SEQ ID NO: 774354 - protein, 168 aa, Homo sapiens
MEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 774355 - protein, 124 aa, Homo sapiens
MCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 774356 - protein, 170 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQRSLALSPGPLHSSLGDRARLRLKQKKMFLKSIAGPQGPWQKPNCNPFLKDRFPRGG

SEQ ID NO: 774357 - protein, 124 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQFRVPAHKVTI

SEQ ID NO: 774358 - protein, 237 aa, Homo sapiens; identical to SEQ ID NO: 774352

SEQ ID NO: 774359 - protein, 237 aa, Homo sapiens; identical to SEQ ID NO: 774352

SEQ ID NO: 774360 - protein, 211 aa, Homo sapiens
MHIYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 774361 - protein, 157 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQRSLALSPGYSTVARSWLTATSASWVQAILLPQPPELGLRACAS

SEQ ID NO: 774362 - protein, 482 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSFSEKRKTC

SEQ ID NO: 774363 - protein, 236 aa, Homo sapiens
TSLGATVAPDLLSANNPRLGKAKAPWSLWTLARPQAPGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTR

SEQ ID NO: 774364 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774365 - protein, 481 aa, Homo sapiens; identical to SEQ ID NO: 774364

SEQ ID NO: 774366 - protein, 481 aa, Homo sapiens; identical to SEQ ID NO: 774364

SEQ ID NO: 774367 - protein, 481 aa, Homo sapiens; identical to SEQ ID NO: 774364

SEQ ID NO: 774368 - protein, 532 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEGVWGWWGEERVRPRVGGSPRPVCFQPRCPEGRTVMPASGPRAQPSFLLHPQVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774369 - protein, 485 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRFREGFLEEEANVSAGRRNDVWDASNGRSMA

SEQ ID NO: 774370 - protein, 437 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTR

SEQ ID NO: 774371 - protein, 286 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKRLVAGCAPG

SEQ ID NO: 774372 - protein, 548 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSSTFCSLKVEHECTSMSVLWDSCACLGLRVSAGRRHTWVCVHVCLCEGSVSSSVHGVWAWAPSLARAFHPVGEGC

SEQ ID NO: 774373 - protein, 271 aa, Homo sapiens
QLALTSRWTSGPGLCPLGAMGWAHPLLCGGGGPPALAVTILHRFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774374 - protein, 484 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLTTFCSLKVEHECTSMSVLWDSCACLGLRVSAGRRHTWVCVHVCLCEGSVSSSVHGVWAWAPSLARAFHPVGEGC

SEQ ID NO: 774375 - protein, 73 aa, Homo sapiens
RSLGHWVDVVEKKLLPPFKPQVTSEVDTRYFDDEFTAQSITITPPDRYDSLGLLELDQRTHFPQFSYSASIRE

SEQ ID NO: 774376 - protein, 148 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLQPHLCAQTRIWKTPPPAQAWAVGRLEIQVLIHTSPSEG

SEQ ID NO: 774377 - protein, 548 aa, Homo sapiens; identical to SEQ ID NO: 774372

SEQ ID NO: 774378 - protein, 505 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSLCMVCGLGPHPWPEHFILWGRGADLVGGAPL

SEQ ID NO: 774379 - protein, 471 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAAAAAGAVAAAGKHKEREPAQRGDGRG

SEQ ID NO: 774380 - protein, 534 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRSNWSWTSGAPPGTGDDAAKPWTRGAKEEHGGLIRSPRHEKKTTGPVNTGPCHPQGFEHLTPMQYKAMQAAGQIPASCAS

SEQ ID NO: 774381 - protein, 509 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRCTWVLGQHLLSERKWAVLAIPKSLSGPRPSVVYRHGFPTGPREGAAGVHPVREA

SEQ ID NO: 774382 - protein, 400 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQSGLWSRQNH

SEQ ID NO: 774383 - protein, 322 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPESC

SEQ ID NO: 774384 - protein, 286 aa, Homo sapiens; identical to SEQ ID NO: 774371

SEQ ID NO: 774385 - protein, 286 aa, Homo sapiens; identical to SEQ ID NO: 774371

SEQ ID NO: 774386 - protein, 286 aa, Homo sapiens; identical to SEQ ID NO: 774371

SEQ ID NO: 774387 - protein, 286 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKFPSRNTVCH

SEQ ID NO: 774388 - protein, 214 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTR

SEQ ID NO: 774389 - protein, 158 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMDDSLPGTEL

SEQ ID NO: 774390 - protein, 171 aa, Homo sapiens
MKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKVRAPGIALASLCGGCGLEPDPEAWTLTRAFCCCGLISPTNSP

SEQ ID NO: 774391 - protein, 481 aa, Homo sapiens; identical to SEQ ID NO: 774364

SEQ ID NO: 774392 - protein, 481 aa, Homo sapiens; identical to SEQ ID NO: 774364

SEQ ID NO: 774393 - protein, 481 aa, Homo sapiens; identical to SEQ ID NO: 774364

SEQ ID NO: 774394 - protein, 459 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774395 - protein, 494 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEGHGPSPHFSSILQVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774396 - protein, 470 aa, Homo sapiens
MKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEGVWGWWGEERVRPRVGGSPRPVCFQPRCPEGRTVMPASGPRAQPSFLLHPQVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774397 - protein, 249 aa, Homo sapiens
QYEISKSFMVTLARALLTHFHLVREKATGRYYAMKILRKEVIIAKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 774398 - protein, 233 aa, Homo sapiens [sequence omitted]

SEQ ID NO: 774399 - protein, 294 aa, Homo sapiens
MAQFFQMKRAVSHDLNGVVTEGHQAFSLAVSALLVGIVTIHSPQEPVWMRFNPPLKGELGLEAQDSAPSSVFLRRSRRAVGSHGAQPEWHGLEAPLHKGLAAARGHVVQPAGPVRSADVRPGKPRRAASPRAPRRVPSGPSCAAPRFRYHTKVRAGRGFSLEELRVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARANARLFGIRAKRAKEAAEQDVEKKK

SEQ ID NO: 774400 - protein, 75 aa, Homo sapiens
ACTPAADLSRMTYDKAGGRHSQEGGPDHRHFCGSEEAEQVHGVPAGQRAAAEGVPLQTHPLPQEALGPQEGRQFC

SEQ ID NO: 774401 - protein, 340 aa, Homo sapiens
NGVFPMKRAVSHDLNGVVTEGHQAFSLAVSALLVGIVTIHSPQEPVWMRFNPPLKGELGLEAQDSAPSSVFLRRSRRAVGSHGAQPEWHGLEAPLHKGLAAARGHVVQPAGPVRSARRKARQAKARRIAPRPASGPIRPIVRCPTVSVPHEGARRPRLQPGGAQVAGIHKKVARTIGISVDPRRRNKSTESLQANVQRLKEYRSKLILFPRVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARANARLFGIRAKRAKEAAEQDVEKKK

SEQ ID NO: 774402 - protein, 145 aa, Homo sapiens
LARRQLIYRGGPTTRRVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARANARLFGIRAKRAKEAAEQDVEKKK

SEQ ID NO: 774403 - protein, 269 aa, Homo sapiens
MAQFFQMKRAVSHDLNGVVTEGHQAFSLAVSALLVGIVTIHSPQEPVWMRFNPPLKGELGLEAQDSAPSSVFLRRSRRAVGSHGAQPEWHGLEAPLHKGLAAARGHVVQPAGPVRSADVRPGKPRRAASPRAPRRVPSGPSCAAPRFRYHTKVRAGRGFSLEELRVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRGPL

SEQ ID NO: 774404 - protein, 265 aa, Homo sapiens
SRRAVGSHGAQPEWHGLEAPLHKGLAAARGHVVQPAGPVRSAGEPCARGCPWGSCPRLRLGLRVADARRGALSATVAERWPGGLQARVTAAALLSTRRKARQAKARRIAPRPASGPIRPIVRCPTVSVPHEGARRPRLQPGGAQGEYWQRCGVRKAPKSPLLAQSRDDILRNRCTALMKAHLNPFPSDVLRLFIQASGLEKARACLHLSLVLGPGGRVAGIHKKVARTIGISVDPRRRNKSTESLQANVQRLKEYRSKLILFPRK

SEQ ID NO: 774405 - protein, 223 aa, Homo sapiens
NGVFPMKRAVSHDLNGVVTEGHQAFSLAVSALLVGIVTIHSPQEPVWMRFNPPLKGELGLEAQDSAPSSVFLRRSRRAVGSHGAQPEWHGLEAPLHKGLAAARGHVVQPAGPVRSARRKARQAKARRIAPRPASGPIRPIVRCPTVSVPHEGARRPRLQPGGAQGGRHSQEGGPDHRHFCGSEEAEQVHGVPAGQRAAAEGVPLQTHPLPQEALGPQEGRQFC

SEQ ID NO: 774406 - protein, 216 aa, Homo sapiens
RLFRSAVFLRRSRRAVGSHGAQPEWHGLEAPLHKGLAAARGHVVQPAGPVRSARRKARQAKARRIAPRPASGPIRPIVRCPTVSVPHVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARANARLFGIRAKRAKEAAEQDVEKKK

SEQ ID NO: 774407 - protein, 212 aa, Homo sapiens
QRHRPGASANAGVDGPLLLRRQRSAAARALGAAGRPSLEGSGRRPGGVRAPGVRPLTRSPLVRSRRAVGSHGAQPEWHGLEAPLHKGLAAARGHVVQPAGPVRSARRKARQAKARRIAPRPASGPIRPIVRCPTVSVPHEGARRPRLQPGGAQGGRHSQEGGPDHRHFCGSEEAEQVHGVPAGQRAAAEGVPLQTHPLPQEALGPQEGRQFC

SEQ ID NO: 774408 - protein, 294 aa, Homo sapiens; identical to SEQ ID NO: 774399

SEQ ID NO: 774409 - protein, 225 aa, Homo sapiens
NGVFPMKRAVSHDLNGVVTEGHQAFSLAVSALLVGIVTIHSPQEPVWMRFNPPLKGELGLEAQDSAPSSVFLRRSRRAVGSHGAQPEWHGLEAPLHKGLAAARGHVVQPAGPVRSARRKARQAKARRIAPRPASGPIRPIVRCPTVSVPHEGARRPRLQPGGAQGGRHSQEGGPDHRHFCGSEEAEQVHGVPAGQRAAAEGVPLQTHPLPQEALGPGPFNASGPF

SEQ ID NO: 774410 - protein, 89 aa, Homo sapiens
SVVCEYQQKPPGQQPEVRWLWWAWWLSTSRSRVDSNRKCRGSGLWAVVAKHAFLAEWWHSACPLWASLRFCSPASAVLRFVMESQHPLP

SEQ ID NO: 774411 - protein, 88 aa, Homo sapiens
SHIVTPSPTSAEEAIWEAHHPAQEEMKPGGRRMSGMTPHLCNSHVLLLPLAWLIRGPAPGSIQSVFLLLASHLLCFLRDVSVAASEPT

SEQ ID NO: 774412 - protein, 109 aa, Homo sapiens
MAKRGLSQRLMKTLVGGPRMNPLSLGISPEREKTPTAVTRKMTILATVPQVLTSPRGTVDNDADTIVKKTGHQQRPAGEGLTFQIHCCSELRSPGPGATEHLKNNSFDQ

SEQ ID NO: 774413 - protein, 141 aa, Homo sapiens
MQGLLCSPSHRGWHPRWELSFITKPEDNGETDREGLQAATAGRCVDADGMGRWRRGPASLPSCPSQRTPGPQLGRPTRLLSLRFSIDKIMSRHPQTTGRRHQPGRVQLERRRPRGYTVLRQNAEVNDRILFAKLYYEAKGI

SEQ ID NO: 774414 - protein, 182 aa, Homo sapiens
MAEEQVNRSAGLAPDCEASATAETTVSSVGTCEAAAKSPEPKDYDSTCVFCRIAGRQDPGTELLHCENEDLICFKDIKPAATHHYLVVPKKHIGNCRTLRKDQVELVENMVTVGKTILERNNFTDFTNVRMGFHMPPFCSISHLHLHVLAPVDQLGFLSKLVYRVNSYWFITADHLIEKLRT

SEQ ID NO: 774415 - protein, 182 aa, Homo sapiens; identical to SEQ ID NO: 774414

SEQ ID NO: 774416 - protein, 182 aa, Homo sapiens; identical to SEQ ID NO: 774414

SEQ ID NO: 774417 - protein, 102 aa, Homo sapiens
MGFEERLSRTPNKLHYVKRSRASVMSPRRAGRSATWQTSCVITNEAQGSGRLSAAPLRALYWQPVLRPASGFEVPHRVSFPLPKAWITAQRQARGDVSRMRT

SEQ ID NO: 774418 - protein, 89 aa, Homo sapiens
SWDTTWHCGGSGGDTQTRAIEGPWTRKRRGRWGQEACGAMCGGRLGGGSCWGGAERPQQPTGESAAGVLVWGPGPDVEAMEGCRGWQWG

SEQ ID NO: 774419 - protein, 155 aa, Homo sapiens
INYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSP

SEQ ID NO: 774420 - protein, 70 aa, Homo sapiens
PNCYKCNSNGKKCRTTAVGLGSQRLGQSLCQQILSKLPLGGHSGWLLRAPTTKDLAPAKPDVTAGSASCC

SEQ ID NO: 774421 - protein, 69 aa, Homo sapiens
PGGLRKLGGLAWPARGEVRRLRGGVACAPDCAVGPAFDEVAAAGSLGPSLVPARAAAAFQTQGMRPVGV

SEQ ID NO: 774422 - protein, 35 aa, Homo sapiens
MQLCRASPVRCRVFQTLLSKMSKCVLPTLALCPCC

SEQ ID NO: 774423 - protein, 109 aa, Homo sapiens
RATDPINSLKGKQDPCDSTDESSNITLRERSHTQVQVKFKNRQELIYGGRNQNSSCFWDKERINWKKKHEGIFWDKRKILPLNWNVGYMGAYHCHNSLHGKLHICAFLF

SEQ ID NO: 774424 - protein, 38 aa, Homo sapiens
PPPEFKRFSCLSLPSSGDYSPPRSVQVTQWHPKQRQDR

SEQ ID NO: 774425 - protein, 110 aa, Homo sapiens
GSLWTPPSNALIQQTGPLCCALGLIAEANLSSFSPSLRDAFHAQPRDQARSYKSISRSPCSNYGTTVIIEPRGNYGNIISRINTTIPPSTFSPHEESEESRTCRINSIIC

SEQ ID NO: 774426 - protein, 192 aa, Homo sapiens
MSDANLDSSKKNFLEGEVDDEESVILTLVPVKDDANMEQMEPSVSSTSDVKLEKPKKYNPGHLLQTNEQFTAPQKARCKIPALPLPTILPPINKVCRDTLRDWCQQLGLSTNGKKIEVYLRLHRHAYPEQRQDMPEMSQETRLQRCSRKRKAVTKRARLQRSYEMNERAEETNTVEVITSAPGAMLASWARI

SEQ ID NO: 774427 - protein, 142 aa, Homo sapiens
MQWLQELFSNPGTFQVFFPNSSASNSFISSPNMATRAPDITCTSEFQETRQREKRRACTLTLKKTSKKNHLKFPNLVPKLTWLLSSLENAVFKLKNAMTKSEIDHAYNDNWKTEMKPYKPSTHAIFVLPVDLRTLVKKMWRL

SEQ ID NO: 774428 - protein, 88 aa, Homo sapiens
TLVLREAWPPATAGRSGRPAVLGRRGRQLPGGTDERLWGSRIRAPLPRGGGDAWSRADVAGPGCRGGQAPLPVSRPHHPERAPAPLSS

SEQ ID NO: 774429 - protein, 106 aa, Homo sapiens
KYMPNVKARIRVTFGKTEATVIGRGIGGTREAGSVLFPHGQWSCKCFIGNKSVNCSFSSYVFSVCLLDFTIKTVKANLKLICILNKTDRNLPQNKLVISLKCFLTH

SEQ ID NO: 774430 - protein, 80 aa, Homo sapiens
GRSVGVTEGRQHRRVHGANIRPEIRCYQGFAFTWGCLLHSWATQKDRRKMWFLESLIGMIQKFLYEDPAYDELHEDLEEN

SEQ ID NO: 774431 - protein, 72 aa, Homo sapiens
KVGWKYQTVTATLEEKRKEKAKIHYQNKKQLMGWPGAVLTPVILALWEAEAGRSGGQEIETILANMVKPSLY

SEQ ID NO: 774432 - protein, 43 aa, Homo sapiens
MANELRGDATDVRRLSFEWQETRGGRAQLDCGLGRGSFSKPTL

SEQ ID NO: 774433 - protein, 195 aa, Homo sapiens
SVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 774434 - protein, 218 aa, Homo sapiens
SVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELLTSDDLPASASQSAGTTSLSQRARP

SEQ ID NO: 774435 - protein, 195 aa, Homo sapiens; identical to SEQ ID NO: 774433

SEQ ID NO: 774436 - protein, 108 aa, Homo sapiens
VPVTMDLGFRARVGDGHSRARVLRIRKSGLGLGLVRTDPVSGVWVPGTVNRGSDRVLILEFRGQDLQTGVQRQGPRVNGQLLESGGWGSGIQGPGLQVSGLGIKTGVW

SEQ ID NO: 774437 - protein, 1578 aa, Homo sapiens
MEELETSLFQTRKAHRIEQMVARWLRRSRDSSARAKVAAADGPARNPTQTLIPVRHTVKIDKDTLLQDYGFHISESLPLTVVAVTAGGSAHGKLFPGDQILQMNNEPAEDLSWERAVDILREAEDSLSITVVRCTSGVPKSSFLTEEKRARLKTNPVKVHFAEEVLISGHSQGNSLLCMPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGPRDVSTAEPSATSLQNKASTSSPENSLPCGPDGRQPSRRGGVKKYAKTLRKRRSFLQTDYTSQVSFPLVPSASLESVDDVCYYDREPYLALGAPSPTVSSLQDMQGEPGLLETKALGLLAPLRETKSTNPASRVMEMEPETMETKSVIDSRVSSISAIRFRIDPNNKENSGVVPAASSSASTPHCSNPGSSGPDTAQARPSQILPLSQDLDGIAPKEPTIEHGDSSFSLSSGDPNPDRACLASNPGLNNVSQGDTLELQLEPHVQLEMGLESFCTNHIQETAPKYTEPLLSPRDEPRSDECGINPGEKIASIPTKEEPQGQLSLERDREVTNKNGTNVFQEESRKDSGDSPGDVSNNVSQTLDISSPAGKIVTSLSLDAPVTGTEQIPPHPPRDPQGQSREPPGQGCQAQEQKLFVELDLDPDFFLGKQTVSPAVPPEGIKAEAPNHVTGQDIAPRDSPEWVCFNPEPSLPEPLPCPQEDPHLETSNHCLLSEGKSDSSSICLSAEKSFLCFAPESHPEVSASLRVATSLGFAGMNEMVAPRIGMDQCSCQFSYATCFRGPQPETEEEDRDLEAHPMAPLTSPPSAGSPVVLPWRPARAHSCTTAPLSRKSHIWPEYCSRALRQLKATPASTPEGFIQLMESLLELQDILETSWGVGNKHPPEKCTWHFTESRSRLCMGSQKLLSSCRHVIRMDQSPEEMQGAVRDTFQHLVQLAGLCFQFTDCSRCSARHREAAGNLRDVVYTYHQFIEAAKSTCERGYHDLSVKLLARQCTALTAAVFCLTQKFRASTAL

SEQ ID NO: 774438 - protein, 280 aa, Homo sapiens
TRKERLDRTLSASIIALRSSGRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFDVK

SEQ ID NO: 774439 - protein, 201 aa, Homo sapiens
LLPGGRRRGGRGRPLSLASARLRCGLRRAFPSELPSLGPPRSAPAARPLPPRPPPQPLPRRAPPDSGGRSAHLGSEEVDRGGCRRIRRIPGPDRTKPARPSPPRATPAPPASSTSHLLLFPIVFRWRARLRNLQSVGCPPFELRDCRPPLGSWMKPTPSPSGVPVRSGDATFPKAMDNVTVRQGESATLRWRNFQERSEGA

SEQ ID NO: 774440 - protein, 60 aa, Homo sapiens
MVTTPGPCWAEHLAVAFSSLEASTGRSGCKEGVQKRGENTSVQGSGTCFPSLTQGIFLVT

SEQ ID NO: 774441 - protein, 344 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 774442 - protein, 337 aa, Homo sapiens
MHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 774443 - protein, 475 aa, Homo sapiens
LLPGGRRRGGRGRPLSLASARLRCGLRRAFPSELPSLGPPRSAPAARPLPPRPPPQPLPRRAPPDSGGRSAHLGSEEVDRGGCRRIAQDPGPGSHEARAAVSSARHPCASRELHFPSAIGCRSSGKLWLSRMGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 774444 - protein, 154 aa, Homo sapiens [sequence omitted]

SEQ ID NO: 774445 - protein, 316 aa, Homo sapiens
MHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKG

SEQ ID NO: 774446 - protein, 344 aa, Homo sapiens; identical to SEQ ID NO: 774441

SEQ ID NO: 774447 - protein, 376 aa, Homo sapiens
MHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRAEISSQFGYDGKASSPWWTNGVKTASGINQPDLLAESSRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 774448 - protein, 126 aa, Homo sapiens
MTKELKSHSQFGYDGKASSPWWTNGVKTASGINQPDLLAESSRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 774449 - protein, 104 aa, Homo sapiens
SIPYGSWVVLELGFFRMGFVLWVAGKVASGLAPQCRAAGRGVGRQGGREAPMFTCLGKKLLVGGLHCGLGSWGPLPGQWGQLSRVPKALEWPRFLPAQAFSPKY

SEQ ID NO: 774450 - protein, 171 aa, Homo sapiens
MAVATDFYLAWCSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSD

SEQ ID NO: 774451 - protein, 125 aa, Homo sapiens
MEFCSVAWAGLELLSSGNLPTSASQSAGITGLSHWTWLLLLLSLMVLEVHWAQVCSSQSGVSMQLWSAGSWSLLMSSSLTCLMTDADVAVLCDLSETCQPKHLHMASPPGLGFIRAWCLDFKSKC

SEQ ID NO: 774452 - protein, 150 aa, Homo sapiens
HTTHHAYIHHTPHNPTQHINTSHTHTPHTTHTTRHIHTIHTPHRYITHTPHTDTPKAHRYHTHPHRKHTDTTHTPTESTQIPHTPPQKARRYPPHTHRKCTDTTHTHTQKAHTAFTPHIYFFALKSRSMSKAACEAGQCSREGRIISHTK

SEQ ID NO: 774453 - protein, 222 aa, Homo sapiens
VHVLLIAASPVPGTVLGTKYLLLLVNCMNELLYTFLTSSFGGLVLDIKRKAPWYWSDYRDALSLQCLASFLFLYCACMSPVITFGGLLGEATEGRISAIESLFGASMTGIAYSLFAGQALTILGSTGPVLVFEQDSVQILKDYALSYLSLRACIGLWTAFLCIVLVATDASSLVCYITRFTEEAFASLICIIFIYEAIEKLIHLAETYPIHMHSQLDHLSLY

SEQ ID NO: 774454 - protein, 105 aa, Homo sapiens
MGSSQAHWPRSRRQSLPALQVQMLLPQTDREQRVKNILHTQQEMGNPTQARKSAQPEAGTHPGHPRWAVASTSRNPQPPTSSKEPPRLNSGCQVLCPALPSHTES

SEQ ID NO: 774455 - protein, 122 aa, Homo sapiens
EKETERERERQMNRRTTLCIWVMLQGGLNRLSMSCFEESKEFWGYCCARENRFERKKTEAGSLTEQEVTRSCLGRHPARGIAQGSAEGSLWGSGWGGEMAWPWAVGLGTGVQPQLSSKPPSV

SEQ ID NO: 774456 - protein, 483 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774457 - protein, 465 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774458 - protein, 80 aa, Homo sapiens
GRASPGPTVPFFTTGCQNTFGGRVIEQLGGKQLVMNHMHHEDQQVRYNALLAVQKLMVHNWEYLGKQLQSEQPQTAAARS

SEQ ID NO: 774459 - protein, 69 aa, Homo sapiens
LGHKAALGGVTAVIEQLGGKQLVMNHMHHEDQQVRYNALLAVQKLMVHNWEYLGKQLQSEQPQTAAARS

SEQ ID NO: 774460 - protein, 483 aa, Homo sapiens; identical to SEQ ID NO: 774456

SEQ ID NO: 774461 - protein, 483 aa, Homo sapiens; identical to SEQ ID NO: 774456

SEQ ID NO: 774462 - protein, 300 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNLDKTFGSVR

SEQ ID NO: 774463 - protein, 404 aa, Homo sapiens
VLPRGPMDGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774464 - protein, 483 aa, Homo sapiens; identical to SEQ ID NO: 774456

SEQ ID NO: 774465 - protein, 483 aa, Homo sapiens; identical to SEQ ID NO: 774456

SEQ ID NO: 774466 - protein, 483 aa, Homo sapiens; identical to SEQ ID NO: 774456

SEQ ID NO: 774467 - protein, 483 aa, Homo sapiens; identical to SEQ ID NO: 774456

SEQ ID NO: 774468 - protein, 425 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVASRPGDLYERR

SEQ ID NO: 774469 - protein, 153 aa, Homo sapiens
DSQHREQQQLRLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774470 - protein, 78 aa, Homo sapiens
RRSEVRGGVLSSWAIPVYKPPVIEQLGGKQLVMNHMHHEDQQVRYNALLAVQKLMVHNWEYLGKQLQSEQPQTAAARS

SEQ ID NO: 774471 - protein, 100 aa, Homo sapiens
NSRPLDLLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774472 - protein, 483 aa, Homo sapiens; identical to SEQ ID NO: 774456

SEQ ID NO: 774473 - protein, 359 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774474 - protein, 256 aa, Homo sapiens
MGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 774475 - protein, 483 aa, Homo sapiens; identical to SEQ ID NO: 774456

SEQ ID NO: 774476 - protein, 483 aa, Homo sapiens; identical to SEQ ID NO: 774456

SEQ ID NO: 774477 - protein, 426 aa, Homo sapiens
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKR

SEQ ID NO: 774478 - protein, 57 aa, Homo sapiens
LNPSHDKLYSFSLSLCLTQNFLEKSTERETRQEYALAMIQCKVLKQLENLEQQKYDD

SEQ ID NO: 774479 - protein, 34 aa, Homo sapiens
MAAGPGPAEADDGRAPGEAELAVSGNRRQWHFHP

SEQ ID NO: 774480 - protein, 563 aa, Homo sapiens
SFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTAIGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 774481 - protein, 231 aa, Homo sapiens
MQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 774482 - protein, 39 aa, Homo sapiens
MHPSSAFLFYLGEPSVDWMIPDETTQIFLTHSTDSNANL

SEQ ID NO: 774483 - protein, 67 aa, Homo sapiens
RHVGHGAGSGSGGRAADLVCGGGRGRGGLFSGGVGAHAVAGGSEEEEERAGRAALRKEVEEAAGVLP

SEQ ID NO: 774484 - protein, 122 aa, Homo sapiens
GRGDDGVDSSGDDDNGGDGDDGGGDVNGSGDGHGEDDDGIGDGEDDDGGGGGDNDDDDVKEKEREEDREIKRSKYVTTLTTSKGVWVFTVSFLQIFHWFEIVQNNKLRKINPEESLSHIFHH

SEQ ID NO: 774485 - protein, 107 aa, Homo sapiens
MKELQYKCLFDLTEMHIHSHLLTYKLIQFPWYLEVRRGRVSGRERGRLWHHQVALAYPHPCCLFHSSTSSQQSYTSHWPSRLQSWSVAGTGLYLASKQISFSSFLRS

SEQ ID NO: 774486 - protein, 441 aa, Homo sapiens
QRPAAPGVAWTPVRGYCGVASLGPGKFGTGEWRRRAAGPMEARGELGPARESAGGDLLLALLARRADLRREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 774487 - protein, 432 aa, Homo sapiens
GSLPRTTRRDLGAPNPPGDADLGGARLAPLGLVAAMLLETGLERDRARPGAAAVCTLGGTREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 774488 - protein, 135 aa, Homo sapiens
ARAGGPSPHSSSGQNGPRSPQPVLLCLSREASSSPLKTDWTQRKRRQTLLSACPRPFPRWVSTCPEGTGGSERGAQGPGLPSQLVPRTQKQRGVPINLCPTQSPLMTFRLKSQDTAISLRCLMKQLAHQPVQAPA

SEQ ID NO: 774489 - protein, 315 aa, Homo sapiens
MTTEIGWWKLTFLRKKKSTPKHKKICWARAPGAPGEVSNTPMPVGRAGAHGSARYNMGHKRGPKGTPGGRAHKGGGVLSPNIKKARRGGPTGAVRDTTSQRGSHEGGQKRGGTTHQGGAQGSTEIKKITPGRARGGCDHTRKAQMKEARTSRATESGSSKQTANRMSDKRPRHTTNTHRQSNEKQYTSHRRCVRRRSQRAGPERDNSNTKKGDEQERKRQQTPEKDKEQRKQGAKNRNEEREQRRRKQAEEKREQKQQDEQAKMQDNTAAKSEAEGDREGKQERGQAERRDTGNDEREESTARCEKEKKAKDGEE

SEQ ID NO: 774490 - protein, 103 aa, Homo sapiens
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 774491 - protein, 103 aa, Homo sapiens; identical to SEQ ID NO: 774490

SEQ ID NO: 774492 - protein, 103 aa, Homo sapiens; identical to SEQ ID NO: 774490

SEQ ID NO: 774493 - protein, 103 aa, Homo sapiens; identical to SEQ ID NO: 774490

SEQ ID NO: 774494 - protein, 147 aa, Homo sapiens
AVWGGLPARRGRDARRSPGSGQRAARVRGGLSFFATRPGSAALRLEGTRRQSSALGGVRGPAASSADSDRAGESGRGAGASAGPWAPLWARILYATGFQGLRGLEPCQSPVLCAPLALGCVKRQERAAQMGSPDAFSPFSRSPRVAR

SEQ ID NO: 774495 - protein, 96 aa, Homo sapiens
SGSDGYSSCAGALGTHFWMPRPLPFASGTGDTRDVLRPSRPCSTSTTRSPVLSHMLPFLSQKHPSSRWKIEGLKSGKSQEQAIPGRYEENQEREGN

SEQ ID NO: 774496 - protein, 175 aa, Homo sapiens
MDTSPISSTNILTKPTGPRELFTVLAIKAAAITFWEQIASPVLRSPNTDKGLSIFTAAVHVEFCSPPRATSIAAPRLTGDHSGGCDSVERTRAILQEVLNPSLFSNNTILLHSQKTPKVVDTASKNASWGRWTKTLPRQAPRGRVVAGYNTEDNLVSKRAIARAIVLKTHKMQHV

SEQ ID NO: 774497 - protein, 74 aa, Homo sapiens
SAACSPGSRWRLSLHTSPQAEGAGSGLGQPIKGLPQCSGGLKGSSSAAKVGAQAEEAPRASEGSEDCQHAVTSQ

SEQ ID NO: 774498 - protein, 102 aa, Homo sapiens [sequence omitted]

SEQ ID NO: 774499 - protein, 117 aa, Homo sapiens
MIPVQCGRSSLQGHLQQEGREFRQFRYRSVWETWPCGGRNTVQGHGSACLCYHIICLFLVGPKDLCPKLSPETSAFLFKLQLSFLTKNHVNPPGLWFVFLPLSIISFPPRSLLRFNT

SEQ ID NO: 774500 - protein, 117 aa, Homo sapiens; identical to SEQ ID NO: 774499

SEQ ID NO: 774501 - protein, 781 aa, Homo sapiens
MATQGHLTFKDVAIEFSQEEWKCLEPVQKALYKDVMLENYRNLVFLGISPKCVIKELPPTENSNTGERFQTVALERHQSYDIENLYFREIQKHLHDLEFQWKDGETNDKEVPVPHENNLTGKRDQHSQGDVENNHIENQLTSNFESRLAELQKVQTEGRLYECNETEKTGNNGCLVSPHIREKTYVCNECGKAFKASSSLINHQRIHTTEKPYKCNECGKAFHRASLLTVHKVVHTRGKSYQCDVCGKIFRKNSYFVRHQRSHTGQKPYICNECGKSFSKSSHLAVHQRIHTGEKPYKCNLCGKSFSQRVHLRLHQTVHTGERPFKCNECGKTFKRSSNLTVHQVIHAGKKPYKCDVCGKAFRHRSNLVCHRRIHSGEKQYKCNECGKVFSKRSSLAVHRRIHTVEKPCKCNECGKVFSKRSSLAVHQRIHTGQKTYKCNKCGKVYSKHSHLAVHWRIHTGEKAYKCNECGKVFSIHSRLAAHQRIHTGEKPYKCNECGKVFSQHSRLAVHRRIHTGEKPYKCKECGKVFSDRSAFARHRRIHTGEKPYKCKECGKVFSQCSRLTVHLRIHSGEKPYKCNECGKVYSQYSHLVGHRRVHTGEKPYKCHECGKAFNQGSTLNRHQRIHTGEKPYKCNQCGNSFSQRVHLRLHQTVHTGDRPYKCNECGKTFKRSSNLTAHQIIHAGKKPYKCDECGKVFRHSSHLVSHQRIHTGEKRYKCIECGKAFGRLFSLSKHQRIHSGKKPYKCNECGKSFICRSGLTKHRIRHTGESLTTKLNVTRP

SEQ ID NO: 774502 - protein, 110 aa, Homo sapiens
RGSAEAGSKGSGPRSVESSMTTLMWTVGKKRNTPTHIHVRVCICVCNVCVCVYCWYTHKISQGGTPETDIMGTSGEEEPGVTGYRDEEKETEGSGCASTPREEKWVLCKF

SEQ ID NO: 774503 - protein, 420 aa, Homo sapiens
AAELPAQRVLHRSSQAHEAHGLPSASGPGGWTTDYEAALCGAHFLYKRVAVDPGAQTGVRRGGDACTLGLCTFAAAAFFFFFFVEKWKPGVERGELLIKKKKKKSVGVGWAPNYTSGLCKCWEGAGWCARTSNFFSIYAGLFSYNFFKKKGCGIEMWALVKIFSKISGGFRGAVGGGSILKQNGARKYVDVLTKGIKNNLFCPLYSIAETCGDRMSAPGGGNLRFWRPHRARRHPFYLAGGGTTTSPLLWLPQVIIRRRQFFYKPPSEKRKTSGRFPSFKRHQAGSCSHLRQRRASKNITLHFVSPFLKRNPLENIIQNKKKTFSADTARVEIDPPGAATKNREGAARGKNASTTKRGEQGPPPQGKHTTVFLCGAPPLKKRARRGKTHLHKHTSGREKQPAASRITGGVPPRGLTQPWG

SEQ ID NO: 774504 - protein, 113 aa, Homo sapiens
QQNSRLREFSTAPPRLTRLTGYPAPAAQEAGPQVRRGPRPASGNSALAWLCPPHSHRISVPTRPQSRLLPAARHGTLPQDSHLPVLKSRPASEPPAVPFSYAYTSLRIWPKEV

SEQ ID NO: 774505 - protein, 325 aa, Homo sapiens
AAGFPLACKQEHRVFLSGCENADENPRMLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLA

SEQ ID NO: 774506 - protein, 222 aa, Homo sapiens
TTSPFAPTMSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTP

SEQ ID NO: 774507 - protein, 134 aa, Homo sapiens
PRRGGGRAEAAISALWEAKAGGCSLPSGPAGPSAPPAAASRAALAGAAAKTETAPLPAELHPPGGRAAAAAVGRGSGSASYLQLGLAGVSAATVPAPHCPAPQRSRANHHPRPPWPDGLPKPNFSRIVSTIRYK

SEQ ID NO: 774508 - protein, 108 aa, Homo sapiens
HVAQAGLEFLDLSDPLASASQKCWDYRCEPRCPALKPFLKLFNPVAHSGWAWRTGHGNPVSRQRPHQWVPTVQGALLGGWRALCQSHVAMSFSPLWAQHTPEEVTAPL

SEQ ID NO: 774509 - protein, 383 aa, Homo sapiens
RNNPCVLCTDKNLPESHASEKPAVALIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 774510 - protein, 613 aa, Homo sapiens
MGRGGGGLDVGGGGEGSRDRLSRDGLASWGAEPGGGGSGSGSSSPPSSSSCSSRNKYQPQSGSSGPSSHSPPAAMALQSQASEEAKGPWQEADQEQQEPVGSPEPESEPEPEPEPEPVPVPPPEPQPEPQPLPDPAPLPELEFESERVHEPEPTPTVETRGTARGFQPPEGGFGWVVVFAATWCNGSIFGIHNSVGILYSMLLEEEKEKNRQVEFQAAWVGALAMGMIFFCSPIVSIFTDRLGCRITATAGAAVAFIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 774511 - protein, 613 aa, Homo sapiens; identical to SEQ ID NO: 774510

SEQ ID NO: 774512 - protein, 197 aa, Homo sapiens [sequence omitted]

SEQ ID NO: 774513 - protein, 613 aa, Homo sapiens; identical to SEQ ID NO: 774510

SEQ ID NO: 774514 - protein, 113 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNS

SEQ ID NO: 774515 - protein, 809 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 774516 - protein, 720 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQGQFLPVSFTAGIFLGHLRL

SEQ ID NO: 774517 - protein, 113 aa, Homo sapiens; identical to SEQ ID NO: 774514

SEQ ID NO: 774518 - protein, 118 aa, Homo sapiens
MSCMLSVPKGTRTTFHPGRKCSTAVSPATTSEDLRICTAHPRETGALQPPDVKVTRLLSGLVFLACVFILHMPVISVRFSFFPVKSCDDFLGQLPNGHVLFPLNLQLGAKVDFVCDEG

SEQ ID NO: 774519 - protein, 109 aa, Homo sapiens
QHRLLSPALTAETLQPQLQPLRRGLRGRNDSSKPAADPSPACTPPAVVHCRWSSALSSSHPHGLLTAQLSASLPSLLYRWSSQQPTYRFGGTREGLTYSKHMSWWFVVQ

SEQ ID NO: 774520 - protein, 81 aa, Homo sapiens
SPQRWGELCRIGLEVEVLEINSQVEGTGEALGQSSGNPHCEGGKGNSGPVLRGPQSERKEDTRAIFAEKHQPARGGLDPGD

SEQ ID NO: 774521 - protein, 79 aa, Homo sapiens
LERLQEGEWTEGRQWLKWKRSNEAMSSRIGQPAEWLEGRGQSLGGEEVKTQRSQHLKVGMATNDGMMTGLCWEQQASRS

SEQ ID NO: 774522 - protein, 124 aa, Homo sapiens
CSPRSFSEVHVNIALPKRAHHLVSRVSQGLGNSLTGALGLPGIGRGPCQAQLCRIGHSLTDSVESSFLSRMQASHSQFTKDLKVGHVCDHCHENIEQQILGQEPNLLLQRCSCGEICFCLFNKH

SEQ ID NO: 774523 - protein, 70 aa, Homo sapiens
IAAPFPDLRLFSYFLFQADFETVKYIKDKFWGVPLAHFPYSVNQELFSAPPDLTYSYFIKKKLEAGNTAK

SEQ ID NO: 774524 - protein, 145 aa, Homo sapiens
AIRTHLCACVCVCHQDACMCVSACHQDTCVCMCMCMPSGRVCTCVPSGRMGVGMCVRAIRTRACVCMRVHAIRFEEHWPLSSLGLPVQQPCPNASPQIATGSSALEPTLCKDAAPLPLRVALHLAGTLIILGRLGIHSESRLDFL

SEQ ID NO: 774525 - protein, 111 aa, Homo sapiens
MGAMAKPDCIITCDSKNLTIKTESTLKTTQFSGTLGEKFEENTADGRRTQTVCNFTDGALVQHQEWDGKESTITRKLKDGKLVVERVMNHVACTRIYEKHNKDSIITLDRS

SEQ ID NO: 774526 - protein, 41 aa, Homo sapiens
MSGEAGQTQLRRLCQLWVVLSEPYPHISCKGTGNKGLGTPG

SEQ ID NO: 774527 - protein, 41 aa, Homo sapiens
QNMTSFPFQLLEVAQEMELLCQCLPDPVSEQPAWPLFMSLG

SEQ ID NO: 774528 - protein, 70 aa, Homo sapiens
WRPTQTLRVYGAPLACLEPWQPPPDVPAPGSMEHFLEEVGLSQPFLDGHGQALDGYLGMRVPRAETWKLK

SEQ ID NO: 774529 - protein, 86 aa, Homo sapiens
EVTRSGQVIGAGRTEVESQPPPKLGSKLLRPQTQTQCRFRGGLPWRSSRGPDEGPCRATGIRESRLTTCACAPRWRERVGSKVAKR

SEQ ID NO: 774530 - protein, 84 aa, Homo sapiens
QEMRLELMLPMKGAQPKSHHQPPGPCSSKEQKLTHWSCTWHCLSLLSKELGWVTPPPLPSTQEELLINYLLGWQLARYHGFQAS

SEQ ID NO: 774531 - protein, 69 aa, Homo sapiens
RRWSTFPRLREYPVHTRHDHHPWGETETPRHRMTMPRFQDLFYNCVGNLAWGLSSCWNSLRVYVDRAMW

SEQ ID NO: 774532 - protein, 104 aa, Homo sapiens
MNVRNLVAFLYTNNTQAESKINNAVTFTTQTHTHTHTHTKPRNTSNQGDERSLQGELQKMLKEITDDNPCHGLEDSMSLKWHTAQSTLQIHWYFYQITNIIFQG

SEQ ID NO: 774533 - protein, 172 aa, Homo sapiens
MRGNSLVAIVRPWRTDGTNSQASARAEIKMFFETNENKDTTYQNLWDTFKAVCRGKFIALNAHKRKQERSKIDTLTSQLKELEKQEQTHSKPSRRQEITKIRAELKEIETQKTLQKINESRSCFFERINKIDRPLARLIKKKREKNQIDAIKNDKGDITTDPTEIQTTIREY

SEQ ID NO: 774534 - protein, 38 aa, Homo sapiens
MAMTSTKYTARKHLVNKARLHSPRSLKPRFYTTQVFVS

SEQ ID NO: 774535 - protein, 222 aa, Homo sapiens
SGVKERRAGLKQSPRTGLEVPGSRVGGGGAALHRRGGAGTPAAVPPPSWTSCGTSARAWPPERCLILEGTIPQSEAAGGVTVNTIGAENKQRRSRSWSSSSDRTRRRRREDSYHVRRRCSRTFSRSSSQHSSRKAKSVEDDTEGHLIYHVGDWLQERYEIVSTLGKGTFGRVVQCVDHRRRGARVALKIIKNVEKYKEAARLEIKVLEKINEKDPGKNLCVQ

SEQ ID NO: 774536 - protein, 177 aa, Homo sapiens
SKDPQVTAFRGGASALLSALGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQ

SEQ ID NO: 774537 - protein, 42 aa, Homo sapiens
MPYSWAGAQVGPTHLQGKLAPLTTLLPAHPHSRPREGGMTVI

SEQ ID NO: 774538 - protein, 105 aa, Homo sapiens [sequence omitted]

SEQ ID NO: 774539 - protein, 670 aa, Homo sapiens
MAEVVAEVAEMPTQMSPGAVEMSTPMSAEMMEMSTEVTEMTPGEALASSLFFQHHQFMCSECGSLYNTLEEVLSHQEQHMLAVSEEEALTTQNVGLEPELVPGAEGPFQCGECSQLILSPGELLAHQDAHLRESANQIQYQCWDCQELFPSPELWVAHRKAQHLSATVAEPPVPPPLPPPTPLPPPSPPSEVKMEPYECPECSTLCATPEEFLEHQGTHFDSLEKEERNGLEEEEEDDEEDEEDDEEMEDEEAMAEVGDDAVGGDESTAGWAQGCGDCPQHQPSAGARRQHRRTAHSPASATHPFHCSQCQRSFSSANRLQAHGRAHVGGTHECTTCSKVFKKAASLEQHLRLHRGEARYLCVDCGRGFGTELTLVAHRRAHTANPLHRCRCGKTFSNMTKFLYHRRTHAGKSGAPPTGATAPPAPAEPTPPPPPPAPPAQLPCPQCSKSFASASRLSRHRRAVHGPPERRHRCGVCGKGFKKLIHVRNHLRTHTGERPFQCHSCGKTFASLANLSRHQLTHTGARPYQCLDCGKRFTQSSNLQQHRRLHLRPVAFARAPRLPITGLYNKSPYYCGTCGRWFRAMAGLRLHQRVHARARTLTLQPPRSPSPAPPPPPEPQQTIMCTELGETIAIIETSQPLALEDTLQLCQAALGASEAGGLLQLDTAFV

SEQ ID NO: 774540 - protein, 318 aa, Homo sapiens
ALLSSNQTASFGSCSLSLPCSARERTPEGGGWPGGRLSEPLPAMLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNI

SEQ ID NO: 774541 - protein, 89 aa, Homo sapiens
ALLSSNQTASFGSCSLSLPCSARERTPEGGGWPGGRLSEPLPAMLLLWVSVVAALALAVLAPGAGEQRRRAAKAPNVVLVVSDSFIPDD

SEQ ID NO: 774542 - protein, 68 aa, Homo sapiens
CAEARGVGAMTPSRLPWLLSWVSATAWRAARIRAPGPGSSRKGFVAVYSLSFKNGKSAEVSQRQISIT

SEQ ID NO: 774543 - protein, 117 aa, Homo sapiens
CAEARGVGAMTPSRLPWLLSWVSATAWRAARSPLLCHSLRKTSSSQGGKSELVKQSLKKPKLPEGRFDAPEDSHLEKEPLEKFPDDVNPVTKEKGGPRGPEPTRYGDWERKGRCIDF

SEQ ID NO: 774544 - protein, 117 aa, Homo sapiens; identical to SEQ ID NO: 774543

SEQ ID NO: 774545 - protein, 117 aa, Homo sapiens; identical to SEQ ID NO: 774543

SEQ ID NO: 774546 - protein, 67 aa, Homo sapiens
MLFDSISKMVAGATSGHREWMRQLTSLQTESEQGTGGEGCLSSSWEEIKKNIKKLEPPGNAQAKAQT

SEQ ID NO: 774547 - protein, 477 aa, Homo sapiens
MNFLRRRLSDSSFIANLPNGYMTDLQRPEPQQPPPPPPPGPGAASASAAPPTASPGPERKPPPASAPAAQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGCLQYILDCNGIAVGPKQVQAS

SEQ ID NO: 774548 - protein, 582 aa, Homo sapiens
MMNFLRRRLSDSSFIANLPNGYMTDLQRPEPQQPPPPPPPGPGAASASAAPPTASPGPERKPPPASAPAAQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGGPGQPQGMQPPGKVLPPRRLPPGPSLPPSSSSSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 774549 - protein, 113 aa, Homo sapiens
SESLLAKPPPQPPQSPQISPSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 774550 - protein, 101 aa, Homo sapiens
MVFSIFSYLTITTINFRTFLSPQKGTLYPLAITSNPTSSSPKELLMYFMSLRICLFWSAVAGSRFTAGSGFRGHAILLPNPPSRWDYRRPPIRPANFLILR

SEQ ID NO: 774551 - protein, 252 aa, Homo sapiens
DPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQA

SEQ ID NO: 774552 - protein, 172 aa, Homo sapiens
MPRASCCHCLCGPESWTCPSDSGVAAWAGSVTLGCYTFWELDRSGCLGGLWHPGMLYILGTGQEWLLGWALAPWDVIHSGNCNQPLEKSELQEVTLGWDLGTWPGQHGDTRLQQELWSVLGSLGAGLRPWAGFLQAEVLGKWGSQASCRLPHYVASDSSSLMKAIWFITLKL

SEQ ID NO: 774553 - protein, 172 aa, Homo sapiens; identical to SEQ ID NO: 774552

SEQ ID NO: 774554 - protein, 172 aa, Homo sapiens; identical to SEQ ID NO: 774552

SEQ ID NO: 774555 - protein, 172 aa, Homo sapiens; identical to SEQ ID NO: 774552

SEQ ID NO: 774556 - protein, 172 aa, Homo sapiens; identical to SEQ ID NO: 774552

SEQ ID NO: 774557 - protein, 111 aa, Homo sapiens
PCYVAQAAEQHNLSSLQPPPPGFKQFSCLSLPSSWDYRCPPPHPANFFVFLVETGFHHVGQADFKLQTSSDPAPQASQSARITGVSQHARLPFAFDIVFISELQTIQAYQV

SEQ ID NO: 774558 - protein, 50 aa, Homo sapiens
QAKGTVVGMERGTRSLAAVGNPMKRGPGHMWLGLRCQEPRTRFHDSLASI

SEQ ID NO: 774559 - protein, 39 aa, Homo sapiens
RAPLTEETRWRLKAIRSGAPAIRIEPSPSNRFRRPGPSC

SEQ ID NO: 774560 - protein, 32 aa, Homo sapiens
TFATGSQPVGPESAGKKRLGARELGSPVPRPG

SEQ ID NO: 774561 - protein, 79 aa, Homo sapiens
IRSRAGTPELADSSRDMCVSAGCAISFRPPGTQAARGQTSQSSGITGLSHCTWPKHTFLILLSFHQHSLFLFTPYSKSF

SEQ ID NO: 774562 - protein, 125 aa, Homo sapiens
MVKLSIVLTPQFLSHDQSQLTKELQQHVKSVTCPCEYLRKVINSLAVYRHRETDFGVGVRDHPGQHGKTPSPQKLDNLIIIIIGFLRRYTFNILFCTSCLCVSILTFCRGILVITNKNKLYKTKK

SEQ ID NO: 774563 - protein, 86 aa, Homo sapiens
VTQLVSSNIAGLKSKVPGHASMRDRLQGRLILALGSLSWAARITSIVRDPKLCSHLPFPVSAWAMITVTLATLHGHYNTLCHSLLV

SEQ ID NO: 774564 - protein, 107 aa, Homo sapiens
MRLRFWLLIWLLLGFISHQPTPVINSLAVYRHRETDFGVGVRDHPGQHGKTPSPQKLDNLIIIIIGFLRRYTFNILFCTSCLCVSILTFCRGILVITNKNKLYKTKK

SEQ ID NO: 774565 - protein, 155 aa, Homo sapiens
MRLRFWLLIWLLLGFISHQPTPVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRP

SEQ ID NO: 774566 - protein, 100 aa, Homo sapiens
HTKKYKKILDRPPIQVINSLAVYRHRETDFGVGVRDHPGQHGKTPSPQKLDNLIIIIIGFLRRYTFNILFCTSCLCVSILTFCRGILVITNKNKLYKTKK

SEQ ID NO: 774567 - protein, 107 aa, Homo sapiens; identical to SEQ ID NO: 774564

SEQ ID NO: 774568 - protein, 90 aa, Homo sapiens
RCEWFRAEKGGGGEGGLRDFATLLPDSVSGFAVSQGFYKSWFWTVYYGDVESRWGQQQSHQRSLLEKMKLQPKIRNLNRKINTRKINLIN

SEQ ID NO: 774569 - protein, 36 aa, Homo sapiens
SPQKETLPPQQSVLVSPSVLERFSLHGGPRVPRFPP

SEQ ID NO: 774570 - protein, 345 aa, Homo sapiens
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 774571 - protein, 206 aa, Homo sapiens
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGKGPP

SEQ ID NO: 774572 - protein, 269 aa, Homo sapiens
MTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 774573 - protein, 228 aa, Homo sapiens
MSEWMKKGPLEWQDYIYKEVRVTASEKNEYKGWVLTTDPVSAKVLLSPRLECSGEISALCNLHLAGSSDSPALASRVAGTTGICHHVWLILYFLWRRGFAMLPSIVLVNFLEDGSMSVTGIMGHAVQTVETMNEGDHRVREKLMHLFTSGDCKAYSPEDLEERKNSLKKWLEKNHIPITEQGDAPRTLCVAGVLTIDPPYGPENCSSSNEIILSRVQDLIEGHLTASQ

SEQ ID NO: 774574 - protein, 167 aa, Homo sapiens
MSEWMKKGPLEWQDYIYKEVRVTASEKNEYKGWVLTTDPVSANIVLVNFLEDGSMSVTGIMGHAVQTVETMNEGDHRVREKLMHLFTSGDCKAYSPEDLEERKNSLKKWLEKNHIPITEQGDAPRTLCVAGVLTIDPPYGPENCSSSNEIILSRVQDLIEGHLTASQ

SEQ ID NO: 774575 - protein, 68 aa, Homo sapiens
PGALTLELRAKALELERKLTELTQLYKSLQQKAEVKGQRGGEGFNWDLRNRGLLEGVKGACVDVAAGT

SEQ ID NO: 774576 - protein, 167 aa, Homo sapiens; identical to SEQ ID NO: 774574

SEQ ID NO: 774577 - protein, 167 aa, Homo sapiens; identical to SEQ ID NO: 774574

SEQ ID NO: 774578 - protein, 167 aa, Homo sapiens; identical to SEQ ID NO: 774574

SEQ ID NO: 774579 - protein, 127 aa, Homo sapiens
MSEWMKKGPLEWQDYIYKEVRVTASEKNEYKGWVLTTDPVSAKVLLSPRLECSGEISALCNLHLAGSSDSPALASRVAGTTGICHHVWLIFVFFVETGLRHVAQVGLKLLISKDLPTLASQSAGITG

SEQ ID NO: 774580 - protein, 69 aa, Homo sapiens
DAWPIKGKNKADSAFLVADWMHPLVLIYEENDHEGQMAVKQEELASGSEENAVPLPHGLRCPACSEKLL

SEQ ID NO: 774581 - protein, 81 aa, Homo sapiens
FGPETEILEYLSEWTDVLALVQLTNFSLVPVQWRTAYAGVCGFLWATFICFSQQSGDGTFKSAFTILYTKGTSATEGYPKK

SEQ ID NO: 774582 - protein, 106 aa, Homo sapiens
WRQSLTLLPKLVCSSAILAHCNIRLLGLSKSPASASRVAGIIGTRHHAWIIFVFLVEMGFHHVGQADLKLLTLSDPPASASQSAGITGVSRHAQPHASSRLGWCLY

SEQ ID NO: 774583 - protein, 73 aa, Homo sapiens
KGLDTRSWPQRAASGRRSSSASRTPHGHRRVFETDRCPPGSFHRHQKAREHTSQAPKSHSDLGSLQPLPPEFN

SEQ ID NO: 774584 - protein, 168 aa, Homo sapiens
LDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSR

SEQ ID NO: 774585 - protein, 141 aa, Homo sapiens
SGARAPRPGGGRGAHATATVWSGLASAAALTARALLKRSLACAAAPQRCGWRRLLCSSLGSRGQGGQAHRGAHLRVVRYGTASVFGTPRLVASQIQHVPSGPAPRPGASHPATPSIQTLRQPLHLSPDIAVPGASSAGAGA

SEQ ID NO: 774586 - protein, 301 aa, Homo sapiens
MELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNA

SEQ ID NO: 774587 - protein, 47 aa, Homo sapiens
KVEDLQFRVEEESITKGDLEVKPLQLSYSFYGYQYSEHGRNNAPIEM

SEQ ID NO: 774588 - protein, 67 aa, Homo sapiens
SALAIHRHLAYSSHPDILAFPSMSWNWKPKWTSCEQWWKLLTGRRWSFSTSLKRRKGDPRLFPGASV

SEQ ID NO: 774589 - protein, 387 aa, Homo sapiens
GTRYSSAPRLFIAPRHSCLPQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNA

SEQ ID NO: 774590 - protein, 159 aa, Homo sapiens
MASLSAPEISVFLRNPSVAYNLSHPTTPLGYKFNNFLYKGAHYFWLHFYNILQAGPLSIHSKRTLKILALTVYLLLKVCSDSPLPTGFLFFKLRLLSLTFEDLFSSACLPVQPRLPQSVKSMRTGPRCVSAHTPHMVDSELPLSELEKEAHESTPEISE

SEQ ID NO: 774591 - protein, 121 aa, Homo sapiens [sequence omitted]

SEQ ID NO: 774592 - protein, 148 aa, Homo sapiens [sequence omitted]

SEQ ID NO: 774593 - protein, 95 aa, Homo sapiens
RNFPGLQSLPCMSCKSSQNVTRDEEMGTAIRPGDGPPWSWAFKRMSAAEDVSREPFSDCLGKASLVVEDASLLGRGGSSSCRQEAAPTGSCSKSH

SEQ ID NO: 774594 - protein, 124 aa, Homo sapiens
IYKDVFCHFPHLKERVSCSPVLLPRRLGKRGPKLLGHVDGDSTPTGLHTVGLVGGVGLGQRGAISASWAVINGLSTCGIETWALQAGGPRHTPTHPQNRVDTPWSDGAGGDPCSKERTKSQSGG

SEQ ID NO: 774595 - protein, 251 aa, Homo sapiens
RVKTKMSDSEVWGMTLSFPGSACGEDGEWVHTSQICATITLKHTMATKGMRLKSTKEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVG

SEQ ID NO: 774596 - protein, 88 aa, Homo sapiens
MNMSKQPVSNVRAIQANINIPMGAFRPGAGQPPRRKECTPEVEEGVPPTSDEEKKPIPGAKKLPGPAVNLSEIQNIKSELKYVPKAEQ

SEQ ID NO: 774597 - protein, 81 aa, Homo sapiens
AGLGEDGEEMGRRDLVSGGSNEGNGKEDWAMKTDSDEAMSGLLPVVGQMISMITELATMGSMINGLRIEAATPAQVHGHPA

SEQ ID NO: 774598 - protein, 67 aa, Homo sapiens
KDPAFGGIHETPSSPISGQPCGDDQNASPSKLSKEELIQSMDRVNREIAKVQHQILKLKKKQVNVFA

SEQ ID NO: 774599 - protein, 122 aa, Homo sapiens
GDIQTALWRGTHDMNLKPPASGQCQITKALVSRSFSPRSAGVCWRSTPDPVSLGIISGSCRTAKIAACSFLWKLHPKGAPAKMPAGALLYEVSFNPCWELSPRQEAWGSGTHLRGSLSLSRA

SEQ ID NO: 774600 - protein, 283 aa, Homo sapiens [sequence omitted]

SEQ ID NO: 774601 - protein, 220 aa, Homo sapiens
CLPVEHVNQLTTEPATGPFSETQSSLRDSEEEVDVVGDSSASKEQCKENTNNELDTSLESMPASGEPEPSPVLDCVSAQMMSLSEPQEHRYTLRTSPRRAAPTRGSPTKNSSPYRENGQFEENNLSPNETNATVSDNVSQSPTNPGEISQNEKGICCDSQNNGSEGVSKPPSEARLNIGHLPSAKESASQHITEEEDDDPDVYYFESDHVALKHNKEYVS

SEQ ID NO: 774602 - protein, 283 aa, Homo sapiens [sequence omitted]

SEQ ID NO: 774603 - protein, 251 aa, Homo sapiens
MLPLSDGPEGSSSRPQMIRGRLCDDTKPETFNQLWTVEEQKKLEQLLIKYPPEEVESRRWQKIADELGNRTAKQSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 774604 - protein, 283 aa, Homo sapiens [sequence omitted]

SEQ ID NO: 774605 - protein, 495 aa, Homo sapiens
MAEPTSDFETPIGWHASPELTPTLGPLSDTAPPRDRWMFWAMLPPPPPPLTSSLPAAGSKPSSESQPPMEAQSLPGAPPPFDAQILPGAQPPFDAQSPLDSQPQPSGQPWNFHASTSWYWRQSSDRFPRHQKSFNPAVKNSYYPRKYDAKFTDFSLPPSRKQKKKKRKEPVFHFFCDTCDRGFKNQEKYDKHMSEHTKCPELDCSFTAHEKIVQFHWRNMHAPGMKKIKLDTPEEIARWREERRKNYPTLANIERKKKLKLEKEKRGAVLTTTQYGKMKGMSRHSQMAKIRSPGKNHKWKNDNSRQRAVTGSGSHLCDLKLEGPPEANADPLGVLINSDSESDKEEKPQHSVIPKEVTPALCSLMSSYGSLSGSESEPEETPIKTEADVLAENQVLDSSAPKSPSQDVKATVRNFSEAKSENRKKSFEKTNPKRKKDYHNYQTLFEPRTHHPYLLEMLLAPDIRHERNVILQCVRYIIKKDFFGLDTNSAKSKDV

SEQ ID NO: 774606 - protein, 218 aa, Homo sapiens
MAEPTSDFETPIGWHASPELTPTLGPLSDTAPPRDRWMFWAMLPPPPPPLTSSLPAAGSKPSSESQPPMEAQSLPGAPPPFDAQILPGAQPPFDAQSPLDSQPQPSGQPWNFHASTSWYWRQSSDRFPRHQKSFNPAVKNSYYPRKYDAKFTDFSLPPSRKQKKKLKPEWVLCAELKAFHWRSPRIIEKPQGYLATMWVPPIGAVGHYTLGALGTDVY

SEQ ID NO: 774607 - protein, 495 aa, Homo sapiens; identical to SEQ ID NO: 774605

SEQ ID NO: 774608 - protein, 405 aa, Homo sapiens
MLATFQTALQAEAGTQTVLAEKPEKQLSVLDHIESLFGTFASIQSRDVKNSYYPRKYDAKFTDFSLPPSRKQKKKKRKEPVFHFFCDTCDRGFKNQEKYDKHMSEHTKCPELDCSFTAHEKIVQFHWRNMHAPGMKKIKLDTPEEIARWREERRKNYPTLANIERKKKLKLEKEKRGAVLTTTQYGKMKGMSRHSQMAKIRSPGKNHKWKNDNSRQRAVTGSGSHLCDLKLEGPPEANADPLGVLINSDSESDKEEKPQHSVIPKEVTPALCSLMSSYGSLSGSESEPEETPIKTEADVLAENQVLDSSAPKSPSQDVKATVRNFSEAKSENRKKSFEKTNPKRKKDYHNYQTLFEPRTHHPYLLEMLLAPDIRHERNVILQCVRYIIKKDFFGLDTNSAKSKDV

SEQ ID NO: 774609 - protein, 120 aa, Homo sapiens
GRRAARTISSVPAIAIVSDPWSQLCCCQPPSPVRLYPGLCSCGFEQIDERHRKKALAACVWVTTRGQHVRDQCRPRCLLEHTGSLLGKLQILSDCEVEESKSLHCFLLNDQPTKEFRMPK

SEQ ID NO: 774610 - protein, 247 aa, Homo sapiens
MSLPSRQTAIIVNPPPPEYINTKKNGRLTNQLQYLQKVVLKDLWKHSFSWPFQRPVDAVKLKLPDYYTIIKNPMDLNTIKKRLENKYYAKASECIEDFNTMFSNCYLYNKPGDDIVLMAQALEKLYSNFIRRIQTKIKDLLQQMEEGLKTADPHDCSAYTGWTGIALLYLQLYRVTCDQTYLLRSLDYVKRTLRNLNGRRVTFLCGGCWPPGCWSCDFITNSEVTVSPGMCHKTFAAPEIGCLPRIR

SEQ ID NO: 774611 - protein, 947 aa, Homo sapiens
MSLPSRQTAIIVNPPPPEYINTKKNGRLTNQLQYLQKVVLKDLWKHSFSWPFQRPVDAVKLKLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKEHVKKMKNECILPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 774612 - protein, 947 aa, Homo sapiens; identical to SEQ ID NO: 774611

SEQ ID NO: 774613 - protein, 947 aa, Homo sapiens; identical to SEQ ID NO: 774611

SEQ ID NO: 774614 - protein, 446 aa, Homo sapiens
MSLPSRQTAIIVNPPPPEYINTKKNGRLTNQLQYLQKVVLKDLWKHSFSWPFQRPVDAVKLKLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFR

SEQ ID NO: 774615 - protein, 947 aa, Homo sapiens; identical to SEQ ID NO: 774611

SEQ ID NO: 774616 - protein, 989 aa, Homo sapiens
MSLPSRQTAIIVNPPPPEYINTKKNGRLTNQLQYLQKVVLKDLWKHSFSWPFQRPVDAVKLKLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKVNVALKGRTSFSDYKSNSSLQRNLKIKKKMKEIKIIQVTLSGEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKEHVKKMKNECILPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 774617 - protein, 538 aa, Homo sapiens
MLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 774618 - protein, 608 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 774619 - protein, 538 aa, Homo sapiens; identical to SEQ ID NO: 774617

SEQ ID NO: 774620 - protein, 432 aa, Homo sapiens
MLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 774621 - protein, 529 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 774622 - protein, 532 aa, Homo sapiens
QVARLGGAGSDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 774623 - protein, 355 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPT

SEQ ID NO: 774624 - protein, 279 aa, Homo sapiens
QVARLGGAGSDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLLPWKSLTSIIEYYYMWKTTDRYVQQKRLKAAEAESKLKQVYIPT

SEQ ID NO: 774625 - protein, 529 aa, Homo sapiens; identical to SEQ ID NO: 774621

SEQ ID NO: 774626 - protein, 608 aa, Homo sapiens; identical to SEQ ID NO: 774618

SEQ ID NO: 774627 - protein, 608 aa, Homo sapiens; identical to SEQ ID NO: 774618

SEQ ID NO: 774628 - protein, 608 aa, Homo sapiens; identical to SEQ ID NO: 774618

SEQ ID NO: 774629 - protein, 507 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQMQTDMLNYLEVH

SEQ ID NO: 774630 - protein, 450 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEVQ

SEQ ID NO: 774631 - protein, 368 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYYTVSPVVFLGPT

SEQ ID NO: 774632 - protein, 365 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYMRLTIIPLQ

SEQ ID NO: 774633 - protein, 432 aa, Homo sapiens; identical to SEQ ID NO: 774620

SEQ ID NO: 774634 - protein, 365 aa, Homo sapiens; identical to SEQ ID NO: 774632

SEQ ID NO: 774635 - protein, 321 aa, Homo sapiens
FTSPLSLPPSPCPLPRLLLSVVRLTTWQTLFSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 774636 - protein, 608 aa, Homo sapiens; identical to SEQ ID NO: 774618

SEQ ID NO: 774637 - protein, 608 aa, Homo sapiens; identical to SEQ ID NO: 774618

SEQ ID NO: 774638 - protein, 527 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECSATM

SEQ ID NO: 774639 - protein, 215 aa, Homo sapiens
RPPTTTKFAAASTKLLTDMCNMKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 774640 - protein, 215 aa, Homo sapiens; identical to SEQ ID NO: 774639

SEQ ID NO: 774641 - protein, 316 aa, Homo sapiens
DSIVTPTVSHLLWIWRSTCTGSVYYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFVSRKL

SEQ ID NO: 774642 - protein, 262 aa, Homo sapiens
LAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKVWFQNRRTKWRKRHAAEMASAKKKQDSDAEKLKVGGSDAEDDDEYNRPLDPNSDDEKITRLLKKHKPSNLALVSPCGGGAGDAL

SEQ ID NO: 774643 - protein, 205 aa, Homo sapiens
LAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKAGSITARTSGASDTRGLLHLARTNRTQ

SEQ ID NO: 774644 - protein, 165 aa, Homo sapiens
LAALHNMAEMKTSLFPYALQGPAGFKAPALGGLGAQLPLGTPHGISDILGRPVGAAGGGLLGGLPRLNGLASSAGVYFWARGRCGARLPQWRKRHAAEMASAKKKQDSDAEKLKVGGSDAEDDDEYNRPLDPNSDDEKITRLLKKHKPSNLALVSPCGGGAGDAL

SEQ ID NO: 774645 - protein, 38 aa, Homo sapiens
GTSAHPSLLWNSPPGALLALSTFSTSPQDFPFYYLQQG

SEQ ID NO: 774646 - protein, 67 aa, Homo sapiens
SGRVHWGEGTRPSPAPRQHLGNRKSWLGLVDLGGEGALVGGCSDFEFWSKTLDSFSFMGTEGKECGL

SEQ ID NO: 774647 - protein, 207 aa, Homo sapiens
MRGEKRRDKVNPKSSQRKLNWIPSFPTYDYFNQVTLQLLDGFMITLSTDGVIICVAENISSLLGHLPAEIVGKKLLSLLPDEEKDEVYQKIILKFPLLNSETHIEFCCHLKRGNVEHGDSSAYENVKFIVNVRDICNEFPVVFSGLFSSHLCADFAACVPQEDRLYLVGNVCILRTQLLQQLYTSKAVSDEAVLTQDSDEEPFVGEL

SEQ ID NO: 774648 - protein, 104 aa, Homo sapiens
MQTGFSVTLSNAVELKSPQSEGAGSGDLGSDKARVEDVTAITLFLLCTLIWKQMVSPCPCPLTKNWATGRPWIDLAKAQCWQAVSRWPSVHPPLQLAFLGTCYA

SEQ ID NO: 774649 - protein, 86 aa, Homo sapiens
NWGIREAKRLAQGHTADVRVEMECKHSDSRTCTVFRNGLKLVVCSGVKSKAKFRASSQGVSLGMRDEDPHFLSAEGKSSPQCPPAR

SEQ ID NO: 774650 - protein, 113 aa, Homo sapiens
MDAGWGRGRPQASLLTAGAEGTGRSKSHTLSVCQSDWRRPRKRGARPRTSPHRGGPERAIRNDLLGDEKHYLERIEPAEMENCGKGMGNEAAPPEIRLQDLQQGELGNMDNLS

SEQ ID NO: 774651 - protein, 140 aa, Homo sapiens
KLGTQLTFLLGRNGHLRGLGQLQADISKFLPMAVFLQVEKPVWTALAWPRYKIWSLKRFPRQRQFPTYVPTRTLCTAPWHGCLNSHGFSSRVSRKDGVLVPSTHFPHFFKIFFETRSRSVTQARVQWRNLGLLQPLPPRL

SEQ ID NO: 774652 - protein, 947 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPNTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 774653 - protein, 926 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCAASSGDTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFCWKSQLIMHQRTHVDDKH

SEQ ID NO: 774654 - protein, 160 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCFGWQRPQVSKIKNPCSQIFG

SEQ ID NO: 774655 - protein, 982 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCAASSGDTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 774656 - protein, 188 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWR

SEQ ID NO: 774657 - protein, 103 aa, Homo sapiens
MTPSPTRLPVGLLPLTPRALLFPQVPTALPAVYHFLAACEGICPHSCAAPSMIELWDFLIQQHQPEKAVACTTTHIPGLRYQLHENRHLVYLVHGYRTVPSAH

SEQ ID NO: 774658 - protein, 128 aa, Homo sapiens
ENATGRQLPVFSSGFWHPQRKKRGDPLWPQEAQKHCPGCARKGENLGDPPKAPLGLSTELAQLRAATRDAASFRPVGALLALSASIPSFGPRNHISNDTLADSPASLAASLQRADASPEVVRKGGKAG

SEQ ID NO: 774659 - protein, 73 aa, Homo sapiens
RDEVLGQRTSALLSYEVREAAEAKKHAEPLGMRFDFKVAAVSPRLRSLAVPSKIEEDLPCSQLDCQFLLETLS

SEQ ID NO: 774660 - protein, 143 aa, Homo sapiens
EPPGWLPSELCLLVTATAMPGGRLLGDVAPNFEANTTAGRVRFQDFLGNSLGILFSHPRDFTPVCTTELGRAAKLAPEFAKRNVKLIALSFFFLFLFLFLRRSLALSPRLECSGALLAHCNLGSLQSLHPGFKQFSCLRLLSS

SEQ ID NO: 774661 - protein, 141 aa, Homo sapiens
GEVKLWGPGSQDKVQFQSLCLGYSAFYPAYLSSSLLAPQVPSDAAGEFQRPAGLHQRQHVGWVSIAQWDPQASQPLRFHGQAKRGGLGVPADPELPLCPWDRLAGGESSPSSQVPEFPALQGKDSIPKMSFQSTEEIALDL

SEQ ID NO: 774662 - protein, 53 aa, Homo sapiens
TVQPIMEALRDATRRRTFALVSQAYTSIITDDFAAFVGLPIEEAVKGLLEQGW

SEQ ID NO: 774663 - protein, 34 aa, Homo sapiens
TQQTQHGQCCGRRGPSRGWSFSVLDENLGTAVCT

SEQ ID NO: 774664 - protein, 106 aa, Homo sapiens
MPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 774665 - protein, 106 aa, Homo sapiens; identical to SEQ ID NO: 774664

SEQ ID NO: 774666 - protein, 126 aa, Homo sapiens
RFCQRRTYNLSGREHGVVVAMPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 774667 - protein, 106 aa, Homo sapiens; identical to SEQ ID NO: 774664

SEQ ID NO: 774668 - protein, 126 aa, Homo sapiens
FAPFLFLPQKKSRARASVVAMPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 774669 - protein, 142 aa, Homo sapiens
MPFLDIQKRFGLNIDRWLTIQSGEQPYKMAGRCHAFEKEWIEKKKKKKKKKTVWGRALGRPGKTFLKNHIAGGARGGPKKEKGDTGAKRGYLRGETAGNDVNKRRGDFLQPIKKEAAGGTNAERRSRNTKSPQEREARGRTT

SEQ ID NO: 774670 - protein, 106 aa, Homo sapiens; identical to SEQ ID NO: 774664

SEQ ID NO: 774671 - protein, 106 aa, Homo sapiens; identical to SEQ ID NO: 774664

SEQ ID NO: 774672 - protein, 126 aa, Homo sapiens; identical to SEQ ID NO: 774668

SEQ ID NO: 774673 - protein, 106 aa, Homo sapiens; identical to SEQ ID NO: 774664

SEQ ID NO: 774674 - protein, 106 aa, Homo sapiens; identical to SEQ ID NO: 774664

SEQ ID NO: 774675 - protein, 197 aa, Homo sapiens
AFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 774676 - protein, 104 aa, Homo sapiens [sequence omitted]

SEQ ID NO: 774677 - protein, 461 aa, Homo sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELLPPLFLEVFED

SEQ ID NO: 774678 - protein, 461 aa, Homo sapiens; identical to SEQ ID NO: 774677

SEQ ID NO: 774679 - protein, 461 aa, Homo sapiens; identical to SEQ ID NO: 774677

SEQ ID NO: 774680 - protein, 456 aa, Homo sapiens
MTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELLPPLFLEVFED

SEQ ID NO: 774681 - protein, 110 aa, Homo sapiens
MTENGLTAWDKPKHCPDREHDWKLVGMSEACLHRKSHSERRSTLKNEQSSPHLIQTTWTSSIFHLDHDDVNDQSVSSAQTFQTEEKKCKGNQIFISPLSCVSTRKKISLL

SEQ ID NO: 774682 - protein, 110 aa, Homo sapiens; identical to SEQ ID NO: 774681

SEQ ID NO: 774683 - protein, 74 aa, Homo sapiens
MNNVSALGKETSCSAGSGQEPAGYLPRAGALNPTGSRALICDFLLVGCPAWVPSSTHDLMNKKLARDANSSIYI

SEQ ID NO: 774684 - protein, 44 aa, Homo sapiens
MRKQGVSSKRLQSSGRSQSKGRRGASLAREPEVEEEMEKSALGG

SEQ ID NO: 774685 - protein, 73 aa, Homo sapiens
LPEQRIAGPCRGLTRWLNTGKNWHLESRHLKLAIWRKQQRRANFKKLEENWYAYFQPSENVKEVKVINWVKCC

SEQ ID NO: 774686 - protein, 97 aa, Homo sapiens
SPGPGGNRRNRTVQMPAFPQISVARQLQTPLTCSRLFKIWLPAAASGAQRAAWRVRTPGTQQQVAATSNPTWNMMGSEPASNSRRAVVCKFGQSLQI

SEQ ID NO: 774687 - protein, 566 aa, Homo sapiens
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 774688 - protein, 90 aa, Homo sapiens
PGKGWEKGGTFKDVKNNNPPTRAPPFGPPSKKFPPNPLQPGHNGGGESSPLEQACPTWRDGVGSASLPSLCQASTGARGGAGPSSGSWYE

SEQ ID NO: 774689 - protein, 566 aa, Homo sapiens; identical to SEQ ID NO: 774687

SEQ ID NO: 774690 - protein, 150 aa, Homo sapiens
NSANVSVVDLTCRLEKPANYDDVKKVVNQASEGPLKDILGYTEHQVVSSDFNSDTHSSIFSEGAGIALNDHFVKLISLYDNEFGYTNRVVDHGPHGLQKVRPLDHQPQQEHERKREDLIAGESLPHSVPHHTKNLPSSQFPCRPPEDGGA

SEQ ID NO: 774691 - protein, 270 aa, Homo sapiens
AARMSSAQCPALVCVMSRLRFWGPWPLLMWQLLWLLVKEAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPE

SEQ ID NO: 774692 - protein, 113 aa, Homo sapiens
GRYYYYYYYKFAAASIIIILFFFSFFETESHRVTQAGVEWHNLGSLQSLPPGFKRFSCLSLLSSWDYRHTPPCPANFCIFSRDGISSCWSGWSRTPDLVICPPQPPKVLGLQA

SEQ ID NO: 774693 - protein, 147 aa, Homo sapiens [sequence omitted]

SEQ ID NO: 774694 - protein, 120 aa, Homo sapiens
MSKHFLACKVRVFPRPPRAQGCPGPEPQLGRCNCTWEHGGSMVLASRQLCKVQGSCLFLAPAGSVKHAGRTAPPPLQLALSQWPLQRGHHCHQKLAVSARLECSGAIKAHHGLERLRSTD

SEQ ID NO: 774695 - protein, 114 aa, Homo sapiens
LNPQSPGLDREQLYWQLSQMTNGIKELGPYTLDRNSLYVNGFTHRSSGLTTSTPWTSTVDLGTSGTPSPVPSPTSKYQSMASLLNFTITNLQYEEDMHRPGSRKFNTTERVLQA

SEQ ID NO: 774696 - protein, 75 aa, Homo sapiens
ELGPPDSRRSRSQPLLIYDGISTLAKRSGSLPLAIERAEYSSSGVPPPASPHVNISYNKLLLVQDYRTGHSGSHL

SEQ ID NO: 774697 - protein, 108 aa, Homo sapiens
KEGRHVSKERGNSGLPTVQRSKQNGNCQVLRIIKKMLYHPCGQCQTTVKIILPALPSMPASRLYTGVDELGVWGIFQRQFSVFCEWNIHTHTYMHTHTGVHTYTQKAR

SEQ ID NO: 774698 - protein, 104 aa, Homo sapiens
MEAAERSSSFQVSRGWAGGSREGLGSAMLASQQPGLACPQQGAGQLPALKGRTRAQILPATSRVFLGHWALDGWHLVPLLSWESSCPTHSRILSSPWLLDLWSL

SEQ ID NO: 774699 - protein, 75 aa, Homo sapiens
MCSMSFECFTKPLPHSQEKGISPLCSSWWAFMSAFTLIALVALRTLEGPLSRVQALMAEQLPLQAEAPVALWALE

SEQ ID NO: 774700 - protein, 74 aa, Homo sapiens
VYTLINYYANGLVQLEVLMVTPHRTSCLLEIIYPRVLFPFLGQKPLRACTQINLLMRLLKLVTSEFPSEEMEKV

SEQ ID NO: 774701 - protein, 187 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGVTPTYHGQSGLHM

SEQ ID NO: 774702 - protein, 323 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 774703 - protein, 323 aa, Homo sapiens; identical to SEQ ID NO: 774702

SEQ ID NO: 774704 - protein, 323 aa, Homo sapiens; identical to SEQ ID NO: 774702

SEQ ID NO: 774705 - protein, 323 aa, Homo sapiens; identical to SEQ ID NO: 774702

SEQ ID NO: 774706 - protein, 323 aa, Homo sapiens; identical to SEQ ID NO: 774702

SEQ ID NO: 774707 - protein, 323 aa, Homo sapiens; identical to SEQ ID NO: 774702

SEQ ID NO: 774708 - protein, 141 aa, Homo sapiens
MEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 774709 - protein, 304 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQVEHAFNMISF

SEQ ID NO: 774710 - protein, 270 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVLILNFTCTLKSMCVSTDSPC

SEQ ID NO: 774711 - protein, 323 aa, Homo sapiens; identical to SEQ ID NO: 774702

SEQ ID NO: 774712 - protein, 323 aa, Homo sapiens; identical to SEQ ID NO: 774702

SEQ ID NO: 774713 - protein, 235 aa, Homo sapiens
YSVTGGVFNVTLHVPWVCTISNKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 774714 - protein, 319 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRELHQA

SEQ ID NO: 774715 - protein, 319 aa, Homo sapiens; identical to SEQ ID NO: 774714

SEQ ID NO: 774716 - protein, 288 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGGYKYPPAE

SEQ ID NO: 774717 - protein, 319 aa, Homo sapiens
SDFRDSERTDRDCQPLRVKDSPHPCPPPGAPNSLVSAAARALDAGAAAMAPRAGQPGLQGLLLVAAALSQPAAPCPFQCYCFGGPKLLLRCASGAELRQPPRDVPPDARNLTIVGANLTVLRAAAFAGGDGDGDQAAGVRLPLLSALRLTHNHIEVVEDGAFDGLPSLAALDLSHNPLRALGGGAFRGLPALRSLQLNHALVRGGPALLAALDAALAPLAELRLLGLAGNALSRLPPAALRLARLEQLDVRLNALAGLDPDELRALERDGGLPGPRLLLADNPLRCGCAARPLLAWLRNATERVPDSRRLRCAAPRALL

SEQ ID NO: 774718 - protein, 243 aa, Homo sapiens
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLINNTRNCLRM

SEQ ID NO: 774719 - protein, 219 aa, Homo sapiens
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKATGNCTSGNLFYKSRSVSSQKNRWIN

SEQ ID NO: 774720 - protein, 275 aa, Homo sapiens
LRATAGLRPQPQPVTGGAFRAKLGGLFGVLHGTASDPRPGTGLAGPRGAGWRRRRKMSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKATGNCTSGNLFYKSRSVSSQKNRWIN

SEQ ID NO: 774721 - protein, 243 aa, Homo sapiens
AVAGRRAQSPRGLGGHIVRDQALGSGCAQPSRVRARPQPPLTILAVSSEPRAGPPASPAPPLPRPGPGRRDREPGRGCRSPRQVRGAPALRPRSVAALSIPAPHRPGGASRSRGVMAENALEADGTVRLRARRSIDGHEPVTLDGRRREPPVTDHDNLNERCARTTITERPKRLLPSLNPQSDYSTVGTIRRIVDTSPLVPDAGTRAPDSGRHNTRLITNPISQVDSQRTHPCPTEDPEMAIP

SEQ ID NO: 774722 - protein, 228 aa, Homo sapiens
GCALGRRAPQLAAAAAVSWPLGLESELNPQNWIFRFHVGGPGSRDATLGVLPLRRLGSLLLLPFPASWPRPLRPCEFPPPSLTPEPCPSRPMWPRLPGAGLAPQLRRQDQRLHFTGQMSHGLQMAGPQETVLALPLREGVQAAATAPILLYNLEDGLSDHPLDQGPRCPARRPCSPASAPAPTSPKKPKMQAPGETFPTDWSPPPVEFLNPRVLQASREAPAQRWVGV

SEQ ID NO: 774723 - protein, 87 aa, Homo sapiens
KNRARYLHALSAVTPRPYYPNSLNNPNSLLTPHPAPSFPHSNLCSHKCHIPVVSTAKITDVSALTSSPRTFVWPLLHSGCPSHPPHL

SEQ ID NO: 774724 - protein, 82 aa, Homo sapiens
TARIPFQWHAEHRLWSSVENAVEWTSLSMEPRTPSTDKLPKLWPEKAAEIHMQTLSGSSSGQTHVSHGTDTSLHTKYRRAPT

SEQ ID NO: 774725 - protein, 283 aa, Homo sapiens
DCPDRVLAEISTLAKMSSVKLQLLCSQVLKELLGQGIDYKKILKLTADAKFESGDVKATVAVLSFILSGAAKHSVDGKSLASELQQLGLPKRSHRRAGLVPVVLREADKALVRNASVRCRAVYAVNRVGQVWAGGWTTPLSSSLLQSVEEPMVHLRLEVAAAPGTPSPACCHVPLSRQVPGPPGRTEAGPDPDELPGLRRRVFQDLCGATCPYGVTPSELLFGRQPGSRMLRPWPGLWPPDPQLPHFSLENLVRAPEDLSQASTYPCPWKGHLLACFHNAGTH

SEQ ID NO: 774726 - protein, 142 aa, Homo sapiens
VRQSLSLSARLECSGTISAHCNFHLLRSSNSPASASRTAGITGVCHHAQLIFVFLVETGFHHVGQAGLKLLTSGNPPTLAFESAGITGMSHRARPTLSFKNAQELLAVITYLDSAIPVGIIFFVLSTFLVFPKTLFSEHPLN

SEQ ID NO: 774727 - protein, 87 aa, Homo sapiens
LFTSNWVSLARASRSQGAVFAPALHCPHQTGFPSPGPPGPRALSLHVHCPVRIRLGFPFPALQAPGHCLYTCTALSASLLSFCASCP

SEQ ID NO: 774728 - protein, 53 aa, Homo sapiens
MHCQMSRTPGSSKMKSYDNSQDNYAPQIPVTKEAQISNVGNQEEHDIKTSLIC

SEQ ID NO: 774729 - protein, 291 aa, Homo sapiens
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGI

SEQ ID NO: 774730 - protein, 104 aa, Homo sapiens
ENGVWWDDAWVPSGTVGRIWRYSQLGCLTHTHLSNPFFPASDHLLLKIKGLVSVPGGIKFLSIFKHPGVVHHAGLAVPREGALLSWGDGFHLHSHGGGRCWVGG

SEQ ID NO: 774731 - protein, 86 aa, Homo sapiens
IWRYSQLGCLTHTHLSNPFFPASDHLLLKIKGLVSVPGGIKFLSIFKHPGVVHHAGLAVPREGALLSWGDGFHLHSHGGGRCWVGG

SEQ ID NO: 774732 - protein, 70 aa, Homo sapiens
TAGCGDNISLESCWWPSASTKGDQLSENEANSEQRKEQGGSLITSLGFLDPALSEDRHPKLHKPVNYLFS

SEQ ID NO: 774733 - protein, 147 aa, Homo sapiens
MCCYMPYTWEVVTVVLKPPGLAIYDWLHSAQGKKSQLQVFCGSLSSCFHFLKGEYVDWSPNLGSTGKVKPEILPLTLTRINTLRKGKVERMFPHSRNLYNQVKRGKSRRKQNPNHFSRCSESPPGHRHRCSPTLNATASAYLLTADL

SEQ ID NO: 774734 - protein, 137 aa, Homo sapiens
MAMSRCVFFPHSPFLAVSRETHHYKGFLPEIFHGRPTIRKAAHVYRKSSYPPWQTLCSVVSQLCDNKMAISDLQGAVGNQIKYVIRDIITSIVFNRALCQLLRQSFNKVYRILKLVTITSLRDAVRNLANLVGRGSI

SEQ ID NO: 774735 - protein, 76 aa, Homo sapiens
QLAVEIQTLTVVTDRLGWGNAMKGKFLREKSPRFFSAFSSFLEVVMSGPDYLERVIQKLRADHSYLITMFLQDGRP

SEQ ID NO: 774736 - protein, 105 aa, Homo sapiens
KGDAVGEETFAAQCLDLKHCVAHDPAIRLWALNPREILCTTKKTKGRRTEEQLDLSNHLDKLSPTVGYFNYFSFFTNISTVNTLIHLAPPLCQPHYSKHFMCVLT

SEQ ID NO: 774737 - protein, 67 aa, Homo sapiens
FRQQMKLPETMESGIADKRGLLSKPRNTGLAGNPRSWRRHQMHPSSQPPEGTNPANTSILDFWTPKL

SEQ ID NO: 774738 - protein, 81 aa, Homo sapiens
IWELLSLRQKAEKGDCKSRLAKSKLQFLLLLAREKAIMPLTRGTNGPRVSSLATLRDAPSLTPFPTPVLQTLLLTHILKQL

SEQ ID NO: 774739 - protein, 140 aa, Homo sapiens
CPGRGEPRRSPLPSPPGARPPLTSQQRAGQQQPVQDRAEHVRLHGWRAQGPAQTERTPRRYGAVRGPRGRRAMADPRGPARRLLLFLLLLRPPRRCRRPGPALAQATALPLGGAQRSAHWGRAGPDGGSRPPPPAGLYKL

SEQ ID NO: 774740 - protein, 104 aa, Homo sapiens
MGLCSFPLTDYASASSLSLSQDAVLQEESAFCWAAFRALCCGFLPLTLQALSMLYASYFKCSSFLNQNRKLALQENQVLLILSAFFFFDYSSPNLKHIHSRLRP

SEQ ID NO: 774741 - protein, 355 aa, Homo sapiens
MKVLRHKYLINFYRAIESTSRVYIILELAQGGDVLEWIQRYGACSEPLAGKWFSQLTLGIAYLHSKSIVHREGAATQTGAFALKGVLCTSPISCPFFLFRTPSSISSLFMHSILIIWSRILIKYSLYAKHFMKYNGELPVVLRYHPLSLSLLWALLTTPWLSFLSTLCPHNGFYLPLPLSSSLPSDPWPFSSQSKTKPSPQLMPSLSAAGRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKVQLLIACVAQWRKTQARPLSPLL

SEQ ID NO: 774742 - protein, 392 aa, Homo sapiens
MKVLRHKYLINFYRAIESTSRVYIILELAQGGDVLEWIQRYGACSEPLAGKWFSQLTLGIAYLHSKSIVHREGAATQTGAFALKGVLCTSPISCPFFLFRTPSSISSLFMHSILIIWSRILIKYSLYAKHFMKYNGELPVVLRYHPLSLSLLWALLTTPWLSFLSTLCPHNGFYLPLPLSSSLPSDPWPFSSQSKTKPSPQLMPSLSAAGRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 774743 - protein, 135 aa, Homo sapiens
MGKGDVLEAAPTTTAYHSLMDEYGYEVGKAIGHGSYGSVYEAFYTKQKVMVAVKIISKKKASDDYLNKFLPREIQNLILQMLRQATKRATILDIIKDSWVLKFQPEQPTHEIRLLEAMCQLHNTTKQHQSLQITT

SEQ ID NO: 774744 - protein, 392 aa, Homo sapiens; identical to SEQ ID NO: 774742

SEQ ID NO: 774745 - protein, 135 aa, Homo sapiens; identical to SEQ ID NO: 774743

SEQ ID NO: 774746 - protein, 355 aa, Homo sapiens; identical to SEQ ID NO: 774741

SEQ ID NO: 774747 - protein, 134 aa, Homo sapiens
LTFSPQKVKAQNIAFAHRPPVLWVEGLILLQSPKSVAEGRRRLGVQSGFSLPRFDGSFFWGQVMKVLRHKYLINFYRAIESTSRVYIILELAQGGDVLEWIQRYGACSEPLAGKWFSQLTLGIAYLHSKSIVHR

SEQ ID NO: 774748 - protein, 275 aa, Homo sapiens
TPQGLLSVRGHPVGAGGPRPGRQGSRSEGLVTARTERIASSRPRGPRGLLGTRSVGHLPRGAQALKVEGRNALAAGAWPGRTQPASPATVGDFQGEGAHLPSGARRMLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFWRDSTDIVPAKKWDNAAIQYFQNLLKGKPV

SEQ ID NO: 774749 - protein, 872 aa, Homo sapiens
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 774750 - protein, 95 aa, Homo sapiens
KGDILEDSPSMSQFNAYYKYCLFVAKKGHSFFLLTFSFFSCRIRHEVIVAMVTNQDNPDDLNKCLYAADTAILPHSLVKSHSSYGRHLVDGFIIS

SEQ ID NO: 774751 - protein, 872 aa, Homo sapiens; identical to SEQ ID NO: 774749

SEQ ID NO: 774752 - protein, 142 aa, Homo sapiens
PLPVRVQVKTEKRKMARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 774753 - protein, 142 aa, Homo sapiens; identical to SEQ ID NO: 774752

SEQ ID NO: 774754 - protein, 142 aa, Homo sapiens; identical to SEQ ID NO: 774752

SEQ ID NO: 774755 - protein, 113 aa, Homo sapiens [sequence omitted]

SEQ ID NO: 774756 - protein, 44 aa, Homo sapiens
RRGWRWEEEEEHSPSSYQRAGGGGGGTGVTNSDLSLTKTITNPP

SEQ ID NO: 774757 - protein, 321 aa, Homo sapiens
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLVINHLPHFVRSSHMTLSCFLSLYISLVKSLGKNVLHCVGFEKERSFFLSFQHIVWPSKNSLLV

SEQ ID NO: 774758 - protein, 118 aa, Homo sapiens
PLAFQGLVRARGPGAPLAFVGLEGGDPSGLTLPHPLNALPIGKSEDNTSMGIYLRGGNHKLGQPLPKQEAYKIHLRQRDGRLLPGVGAALFSHPPLLASAAATESSSHLVLIYKLPPC

SEQ ID NO: 774759 - protein, 613 aa, Homo sapiens
PAPVCTAPGPRDPGRSREAGPCAEEWPLGWKPGPAGSGEGALSRRRGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDEGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRELGLPPVSPRDCVKDAVAAEVFDHVWTNMVELLEELIRKHWETTLTEGKKQRETLKVAGNRFPHVLVPRAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGQLFSICK

SEQ ID NO: 774760 - protein, 204 aa, Homo sapiens
LSQHSQLSSSQDFLPRNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGQLFSICK

SEQ ID NO: 774761 - protein, 639 aa, Homo sapiens
PAPVCTAPGPRDPGRSREAGPCAEEWPLGWKPGPAGSGEGALSRRRGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDEGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRELGLPPVSPRDCVKDAVAAEVFDHVWTNMVELLEELIRKHWETTLTEGKKQRETLKVAGNRFPHVLVPRAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTEDNFDFQEEIPSDILKPPHQNHWSTCGLGTLLIT

SEQ ID NO: 774762 - protein, 275 aa, Homo sapiens
PAPVCTAPGPRDPGRSREAGPCAEEWPLGWKPGPAGSGEGALSRRRGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDEGVQHFQGSTPASAVHRPPLSACGHSSNIRELCISGSQIVPAALSASALPGPDDTGVADLTARSSLEEEVYHVDGKIEEYFAFDRKEE

SEQ ID NO: 774763 - protein, 629 aa, Homo sapiens
PAPVCTAPGPRDPGRSREAGPCAEEWPLGWKPGPAGSGEGALSRRRGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDEGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRELGLPPVSPRDCVKDAVAAEVFDHVWTNMVELLEELIRKHWETTLTEGKKQRETLKVAGNRFPHVLVPRAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 774764 - protein, 568 aa, Homo sapiens
AAGAGAGAGAGAGGWGAPAPGPRGRVTGCLRGARARCLCLTVPEPSAEPGAGAASTGPGLIVIGRGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDEGVQHFQGSTPASAVHRPPLSACGHSSNIRELCISGSQIVPAALSASALPGPDDTGVADLTARSSLEEEVYHVDGKIEEYFAFDRKEEREKTERNIESGWKQISARPRSTRSRRWSQWPPVRTAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGQLFSICK

SEQ ID NO: 774765 - protein, 629 aa, Homo sapiens; identical to SEQ ID NO: 774763

SEQ ID NO: 774766 - protein, 98 aa, Homo sapiens
CCAVLVLNTNFRQILTHVIDPIRVFLDASESSEDGSVTNEYEGASVHVSALRHCQMDFAVSPRGTHLLPAMTIKFSSPDLRDVEWRERKPGVSYEESQ

SEQ ID NO: 774767 - protein, 136 aa, Homo sapiens
AERHTGRAALARHGQLSRPHAAVRNSSRGRGAATSVSAAARPTRGGARGHRRADGRARGGCAQLRAGTPSAPGGLQDCRGRQGEENAHPFRSGAPFSPHPHASRSTLAAQLLPLPQPPPPPKLAPPPLPPWLSAVT

SEQ ID NO: 774768 - protein, 279 aa, Homo sapiens
MFRAPCHRLRARGTRKARAGAWRGCTFPCLGKGMERPAAREPHGPDALRRFQGLLLDRRGRLHRQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 774769 - protein, 279 aa, Homo sapiens; identical to SEQ ID NO: 774768

SEQ ID NO: 774770 - protein, 68 aa, Homo sapiens
MIHWKQTRSPSVAVAAPLNSCQVPAGVRAAGRERRLARRLQADRVSMSPQGMERPAAREPHGPDALRR

SEQ ID NO: 774771 - protein, 279 aa, Homo sapiens; identical to SEQ ID NO: 774768

SEQ ID NO: 774772 - protein, 279 aa, Homo sapiens; identical to SEQ ID NO: 774768

SEQ ID NO: 774773 - protein, 61 aa, Homo sapiens
DPLPPRAARPVSQARCPTPVGDGSSSRRCWDNGRVNLRPVVQLIDIMKDLTRLSQDLQHSG

SEQ ID NO: 774774 - protein, 304 aa, Homo sapiens
AQGRSQEAGNMAGQPAATGSPSADKDGMEPNVVARISQWADDHLRLVRNISTGMAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVNKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 774775 - protein, 66 aa, Homo sapiens
KLTKVGFRRSVITNFSNLKQDVRTHRKEAKNLEKRLDEWLTRINSIEKTLNDLTELKTMAQELRDT

SEQ ID NO: 774776 - protein, 102 aa, Homo sapiens
MVFHEAHTGIQCPAPQAGMSNVTFLTLCFPMASGQIIPRESTSENWNGCSLEMLVALFFSGPLTYQKANSNLIHSATAYHVFRVLGVNGLPGKIQSQGTICK

SEQ ID NO: 774777 - protein, 103 aa, Homo sapiens [sequence omitted]

SEQ ID NO: 774778 - protein, 102 aa, Homo sapiens
PYLTQALTTSLKRSFCCYRKNFCKAGSLKSAMIKLPLETLSYLHVSLSLGSHLSNSFQLQSAPGSQICHGEGKKKCPPNKTLGIAGAACNPDFQRLIFFMSR

SEQ ID NO: 774779 - protein, 233 aa, Homo sapiens
YEEASRPQPPACLSKDSTPDEPDVHFSKKFLNIFMSGRSRSSSAESFGLFSCIINREEQEQTHRTIFRFVPRHEDEPELEVDDPLLVELQAEDYWYEAYNMRTGARGFFTAYYAIEVTKEPEHMAALAKNSDWVDQFRVKFLGSVQVPYHKGDVVLSAAMQKIATTRRLTVHFNPPSSCVLEISVRGVKIGVKADDSQEAKGNKCSHFFQLKNISFRGYHPKNNKYFGFITKH

SEQ ID NO: 774780 - protein, 114 aa, Homo sapiens
PPFPGSPAVSRAGRGAAASEQCKAEAGKICLHCKCPQEEHMVTVMPLEMEKTISKLMFDFQRNSTSDDDSGCALEEYAWVPPGLKPEQVPFWMGACWWFGCFTLPYWSFLIPVL

SEQ ID NO: 774781 - protein, 242 aa, Homo sapiens
MLSVLQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAGHGVCWHPPCFVCTVCNELLVDLIYFYQDGKIYCGRHHAECLKPRCAACDEIIFADECTEAEGRHWHMKHFCCFECETVLGGQRYIMKEGRPYCCHCFESLYAEYCDTCAQHIGIDQGQMTYDGQHWHATETCFC

SEQ ID NO: 774782 - protein, 102 aa, Homo sapiens
MLSVLQVHQYYSCLPEEKVPYVNSPGEKLRIKQLLHQLPPHDNEVRYCNSLDEEEKRELKLFSSQRKRENLGRGNVRPFPVTMTGAICEQVSMDSGDEEALF

SEQ ID NO: 774783 - protein, 284 aa, Homo sapiens
MVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAGHGVCWHPPCFVCTVCNELLVDLIYFYQDGKIYCGRHHAECLKPRCAACDEIIFADECTEAEGRHWHMKHFCCFECETVLGGQRYIMKEGRPYCCHCFESLYAEYCDTCAQHIGIDQGQMTYDGQHWHATETCFC

SEQ ID NO: 774784 - protein, 34 aa, Homo sapiens
LLHDLSAFLESLRASVSSPGKWVQYYRKEKNSSE

SEQ ID NO: 774785 - protein, 131 aa, Homo sapiens
ELRNLNRTHLWGNLAPRGPKNSGTKNCLTACSSHWCELQHPLCSKWTPTALAPLVAPARAPAPASAKSANAPPARRAAVPAAPWAVPSVPRAASAKGHRRSAAAVPDVGTALLPDVNRTTCTTWIFLKIQH

SEQ ID NO: 774786 - protein, 114 aa, Homo sapiens
DAWVDPRVRCLTACSSHWCELQHPLCSKWTPTALAPLVAPARAPAPASAKSANAPPARRAAVPAAPWAVPSVPRAASAKGHRRSAAAVPDVGTALLPDVNRTTCTTWIFLKIQH

SEQ ID NO: 774787 - protein, 89 aa, Homo sapiens
GRRVEGNLGETGKGGLDFGNTAYLRGHSPTRANGLQRGGPAVPTAQSSGGGAPGPSAAHSPAQERGRCGLSGPGAGAELGLCARPDLRL

SEQ ID NO: 774788 - protein, 89 aa, Homo sapiens; identical to SEQ ID NO: 774787

SEQ ID NO: 774789 - protein, 131 aa, Homo sapiens; identical to SEQ ID NO: 774785

SEQ ID NO: 774790 - protein, 227 aa, Homo sapiens
RGLEQEGCTGTPGQAQLKTAGRGGGVETPATPRLGSRKARGGGWKAKATSGKLGKAAGPRGHCVPPGAQPLPRKPEPKGRSSGALGAELRGWCARHLCWAQPSPAQDRWRCEPSRAGASAGQGLCARPPPLSRKAAAGCGAPPRRPGGPSSRSIYRLRSPALPRLEMDPNCSCATGGSCTCAGSCKCKECKCTSCKKSCCSCCPVGCAKCAQGCVCKGASEKCSCCA

SEQ ID NO: 774791 - protein, 89 aa, Homo sapiens; identical to SEQ ID NO: 774787

SEQ ID NO: 774792 - protein, 89 aa, Homo sapiens; identical to SEQ ID NO: 774787

SEQ ID NO: 774793 - protein, 127 aa, Homo sapiens
MDPNCSCATGGSCTCAGSCKCKECKCTSCKKSECGAISRNLGLWLRLGGNSRLALSASFWGTGLSLPSLPVSFPLQAFCPKFRWGRTAFFSWDTNPNCTPYGFRTELCQTKKSILWVWVLSSSQACY

SEQ ID NO: 774794 - protein, 227 aa, Homo sapiens; identical to SEQ ID NO: 774790

SEQ ID NO: 774795 - protein, 89 aa, Homo sapiens; identical to SEQ ID NO: 774787

SEQ ID NO: 774796 - protein, 69 aa, Homo sapiens
TSSQAVGKQPQTALGPTGGSCTCAGSCKCKECKCTSCKKSCCSCCPVGCAKCAQGCVCKGASEKCSCCA

SEQ ID NO: 774797 - protein, 104 aa, Homo sapiens [sequence omitted]

SEQ ID NO: 774798 - protein, 283 aa, Homo sapiens
AGGKYLPPSCSPASKMRLGLLSVALLFVGSSHLYSDHYSPSGRHRLGPSPEPAASSQQAEAVRKRLRRRREGGAHAKDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRVRP

SEQ ID NO: 774799 - protein, 153 aa, Homo sapiens [sequence omitted]

SEQ ID NO: 774800 - protein, 696 aa, Homo sapiens
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 774801 - protein, 106 aa, Homo sapiens
RIENPEINPNTYSQLIFDKANKNIKWGKNTLFNKVCWGNWLATCRKMKLDPHLSPYTKINSRWIKDLNLRPETIKILEDNIRKTLLDIGLGKDFMTKNCFWVKAIA

SEQ ID NO: 774802 - protein, 194 aa, Homo sapiens [sequence omitted]

SEQ ID NO: 774803 - protein, 127 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISKRI

SEQ ID NO: 774804 - protein, 127 aa, Homo sapiens; identical to SEQ ID NO: 774803

SEQ ID NO: 774805 - protein, 127 aa, Homo sapiens; identical to SEQ ID NO: 774803

SEQ ID NO: 774806 - protein, 127 aa, Homo sapiens; identical to SEQ ID NO: 774803

SEQ ID NO: 774807 - protein, 127 aa, Homo sapiens; identical to SEQ ID NO: 774803

SEQ ID NO: 774808 - protein, 143 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISVTQCHGIGDYVFKRISKRI

SEQ ID NO: 774809 - protein, 119 aa, Homo sapiens
TRGLRAQVDDLTEAVAAKSQLAVLKVRLQEADQLLTRTEALEALQSESRSIQNEFTVGEECELETMTGEKVKTVVQLEGDNKLVTTFKNIKSVTELNGDIITNTMTLGDIVFKRISKRI

SEQ ID NO: 774810 - protein, 98 aa, Homo sapiens
MPPLHPPTPKLLSCGQYLPALTEDPSCPRQFTHIITNPFCSAQPTSHRGLHLPCMPRVLHKCLCPFSVYKENPIHGHIMAAYKPGTVQLCSQPWCLAA

SEQ ID NO: 774811 - protein, 127 aa, Homo sapiens; identical to SEQ ID NO: 774803

SEQ ID NO: 774812 - protein, 117 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNCKLVVL

SEQ ID NO: 774813 - protein, 131 aa, Homo sapiens
MSFSGKYQLQSQENFEAFMKAIGLPEELIQKGKDIKGVSEIVQNGKHFKFTITAGSKVIQNEFTVGEECELETMTGEKVKGRRASLLLSELSLEPGPGTSFLKAQTSQFHPQIPSLNPPPMWEKQRDKGSS

SEQ ID NO: 774814 - protein, 137 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNYHDIVVTCLQRISDEMLKGDEMLEEP

SEQ ID NO: 774815 - protein, 102 aa, Homo sapiens
MPPLHPPTPKLLSCGQYLPALTEDPSCPRQFTHIITNPFCSAQPTSHRGLHLPCMPRVLHKCLCPFSVYKENPIHGHIMAAYKPGTVHSLIQENWQGWRKHP

SEQ ID NO: 774816 - protein, 102 aa, Homo sapiens
MYQSWAESQPGDDLEEARMWPHVLVALTFKQAKPTLHCMLGVVLVGQRGLSEHSGCHMKLTLPGQTGLWGKAATVIIWPRSGLSRSRAEGGREGMSKKGPGY

SEQ ID NO: 774817 - protein, 262 aa, Homo sapiens
MLLCGYGHYKHKIYLKYLKVITLIKQQRDRKSLAEAREADVHRTNRSEVRKNKGNFWPRPACMPSWVYHPREGPMPRVDTVSPVARAWLGLPPLQGPHATHGHRRASGQSLAGFTTPMRALCHTWTLLAQRPELPKARAAAWRTVTLGVGAVPPTSCNGTVCAAGTWHCAFCVCPRRTLCGDCSTLSTFASPASRNGTACAAGPWHCQLRVCARRTLCGDCSTLSTFASLVAGELRDSVSATSAGPLKLYFIICIKLVCIFN

SEQ ID NO: 774818 - protein, 101 aa, Homo sapiens
FFSRGLIEVMSSRCWEAYHRSPTLTTVTGLSFHESCNPCYKSLKCQPCQEGLRKRQEAGCRALGSEPCCCRDWGSSPGAAVSWLCDLRQVLNLSDPSLPLL

SEQ ID NO: 774819 - protein, 75 aa, Homo sapiens
DAKETLKRVQDRERQAWPGLSRGKLAKKPSNTSRTGIAQPWRRLWRGKDSKMPTSDTFSKQAFLSAYWLPDIEGI

SEQ ID NO: 774820 - protein, 83 aa, Homo sapiens
RVLKKRPHIHKVGSHTAHRRILHAPPRGEVHPHTPTPAQVRPGHQLSGSLQEVVEPYPKFQPCSWLGLQALWGDWHSGTILQG

SEQ ID NO: 774821 - protein, 140 aa, Homo sapiens
AYLHLIPKRMVSSQRTVGPQEPPALPSWGCMQGLGRGGVLWKAPGRRCQSLTLRLPPAAVGGLAVPATCVAQRAGLQNISGMAVGEVVMQPPPTYGNHRAMCLASRGAWLGHAGHRLWFRVGSVKSGPGCGVSRTMTGLP

SEQ ID NO: 774822 - protein, 102 aa, Homo sapiens
QSMRGFLNRARTGAPALQLVSCGPKVLCHVCLALEHSDRAWVHTLAHVHACSNSGASGNKMVHREVFFTQAASNPTTEEPFTLCPSLKSAGFKNLSFQRQLC

SEQ ID NO: 774823 - protein, 225 aa, Homo sapiens
DSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVLDEPKEHRVNQQISPLIHDSTENRRNVTERTTKSMNGAHREPNNCPKTNHQATKMPRATDKSPSNQRENRHQEQRE

SEQ ID NO: 774824 - protein, 112 aa, Homo sapiens
FFFFRWSLTLSPRLECSGTISTHCNLRLPGSSDSPASASRVAGITDAGNHGRLIFVFLEEMGFHHVGQAPDLRRSTRLGLPECWDYRHEPPRPVPINPTLLTGLASIPPPSG

SEQ ID NO: 774825 - protein, 161 aa, Homo sapiens
MNINAKILNKILANRIQQHIKKLIHHDQVSFIPGMQGWFNIHKSINIIQHINRTNDKNHMIISIDAQKAFDKIQHSFMLKTLNKLGIDGMYLKIIRAIYDKPTANIILNGQKLEAFPLKTGTRQGCPLSPLLFNIVLEVLARAIRQEKEIKGIQLGKEEVK

SEQ ID NO: 774826 - protein, 103 aa, Homo sapiens
GNLFRIPPQSYSFPLLLRGKTIWILVCVVPFNLEVFLQERKFIHATLNSFAITKREREREREGWAQWLMPVTPALWEAKVEESLEPKSETSLGKMMTPLFIQK

SEQ ID NO: 774827 - protein, 194 aa, Homo sapiens
RRRTNDVIGDDRVVISSRGTLLEERRDVLRGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774828 - protein, 148 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSGA

SEQ ID NO: 774829 - protein, 168 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774830 - protein, 168 aa, Homo sapiens; identical to SEQ ID NO: 774829

SEQ ID NO: 774831 - protein, 168 aa, Homo sapiens; identical to SEQ ID NO: 774829

SEQ ID NO: 774832 - protein, 199 aa, Homo sapiens
KRVQPTARYEAGCCFQPQSDGRGDASGRNAAMAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774833 - protein, 168 aa, Homo sapiens; identical to SEQ ID NO: 774829

SEQ ID NO: 774834 - protein, 168 aa, Homo sapiens; identical to SEQ ID NO: 774829

SEQ ID NO: 774835 - protein, 168 aa, Homo sapiens; identical to SEQ ID NO: 774829

SEQ ID NO: 774836 - protein, 168 aa, Homo sapiens; identical to SEQ ID NO: 774829

SEQ ID NO: 774837 - protein, 188 aa, Homo sapiens
MGCGAARALASVLCLRRNAAMAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774838 - protein, 168 aa, Homo sapiens; identical to SEQ ID NO: 774829

SEQ ID NO: 774839 - protein, 168 aa, Homo sapiens; identical to SEQ ID NO: 774829

SEQ ID NO: 774840 - protein, 168 aa, Homo sapiens; identical to SEQ ID NO: 774829

SEQ ID NO: 774841 - protein, 196 aa, Homo sapiens
TSCLSSWDYRRRRRLRLRRLNCASAIFPASVGRARRRFWKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774842 - protein, 172 aa, Homo sapiens
MGEAAGCEGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774843 - protein, 170 aa, Homo sapiens
YAGRGWVNRPRRSGLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774844 - protein, 161 aa, Homo sapiens
MCFSTLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774845 - protein, 181 aa, Homo sapiens
SLSPRVCRGRVGPSDEGGRAQCQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774846 - protein, 147 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCAKSMCLPPKEESSATTTFLPKVTTTFETKPFLWAC

SEQ ID NO: 774847 - protein, 70 aa, Homo sapiens
DQLPEELGLQAPASAASPAFELRFRHLSSLSRTGAETLLEGTPRWLRRESPRSSSNLYWLVMVVLEKRPS

SEQ ID NO: 774848 - protein, 192 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFVVAMPASRPQPEKLSIGPQACGAGHKVIEANEL

SEQ ID NO: 774849 - protein, 104 aa, Homo sapiens
MFDVTSRVTYKNVPNWHRDLVRVCENIPIVLCGNKVDINGPGTVKAKSMCLPPKEESSAHVETPNLGILLPFVAMPASRPQPEKLSIGPQACGAGHKVIEATEL

SEQ ID NO: 774850 - protein, 108 aa, Homo sapiens
MAISQSTEFLLAGCVPYIELNRSSVGVEHYGMNLNTQGGYILLLKFTSQMTFHEGRFSSTTITNQYKFELDLGALFVAMPASRPQPEKLSIGPQACGAGHQVIEANEL

SEQ ID NO: 774851 - protein, 179 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSVLLKLGGYGIIRLTLILNPLTKHIAYPFLVLSL

SEQ ID NO: 774852 - protein, 199 aa, Homo sapiens; identical to SEQ ID NO: 774832

SEQ ID NO: 774853 - protein, 95 aa, Homo sapiens
EDPEYRAIPAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774854 - protein, 168 aa, Homo sapiens; identical to SEQ ID NO: 774829

SEQ ID NO: 774855 - protein, 168 aa, Homo sapiens; identical to SEQ ID NO: 774829

SEQ ID NO: 774856 - protein, 168 aa, Homo sapiens; identical to SEQ ID NO: 774829

SEQ ID NO: 774857 - protein, 168 aa, Homo sapiens; identical to SEQ ID NO: 774829

SEQ ID NO: 774858 - protein, 168 aa, Homo sapiens; identical to SEQ ID NO: 774829

SEQ ID NO: 774859 - protein, 196 aa, Homo sapiens
LTARYEDWRFKFGRGSDGRGDASGRNAAMAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774860 - protein, 191 aa, Homo sapiens
KRYVRGRVVTADGRGDASGRNAAMAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774861 - protein, 168 aa, Homo sapiens; identical to SEQ ID NO: 774829

SEQ ID NO: 774862 - protein, 183 aa, Homo sapiens
GCRNDIRLGRGWVVAMAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774863 - protein, 194 aa, Homo sapiens; identical to SEQ ID NO: 774827

SEQ ID NO: 774864 - protein, 146 aa, Homo sapiens
MLTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774865 - protein, 133 aa, Homo sapiens
MSVLGATLGVEVHPLVFHTNRGPIKFNVWDTAGQEKFGGLRDGYYIQAQCAIIMFDVTSRVTYKNVPNWHRDLVRVCENIPIVLCGNKVDINGPGTVKAKSMCLPPKEESSATTTFLPKVTTTFETKPFLWAC

SEQ ID NO: 774866 - protein, 196 aa, Homo sapiens; identical to SEQ ID NO: 774859

SEQ ID NO: 774867 - protein, 95 aa, Homo sapiens; identical to SEQ ID NO: 774853

SEQ ID NO: 774868 - protein, 168 aa, Homo sapiens; identical to SEQ ID NO: 774829

SEQ ID NO: 774869 - protein, 168 aa, Homo sapiens; identical to SEQ ID NO: 774829

SEQ ID NO: 774870 - protein, 69 aa, Homo sapiens
SEQDPNGWLHIKLLPCLLLDPNQKSCPLDPRLVGQATRSLKPPNFRGVAPEQTGFSPGLKGLMTLLEEI

SEQ ID NO: 774871 - protein, 168 aa, Homo sapiens; identical to SEQ ID NO: 774829

SEQ ID NO: 774872 - protein, 106 aa, Homo sapiens
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCF

SEQ ID NO: 774873 - protein, 251 aa, Homo sapiens
TRQLGDADAWALRMLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQK

SEQ ID NO: 774874 - protein, 106 aa, Homo sapiens
MCETVASALAAPQQSKVVNETHNFNFWRTKPLFPALAPASCSRNCHPNSWLPQGWELENDKMLFQMPKFTKIYQLFSSSSTLLDTASVSLDPRVLKYHLKQFLPSQ

SEQ ID NO: 774875 - protein, 111 aa, Homo sapiens
KYQQTRFNSILKGLYTMTNKHMKRYSMLLIKEMQVKTPRCYLTPIRMAAIKNNSWLPQGWELENDKMLFQMPKFTKIYQLFSSSSTLLDTASVSLDPRVLKYHLKQFLPSQ

SEQ ID NO: 774876 - protein, 154 aa, Homo sapiens
APVCYPAGSGGRPGPARRGGPGSRGPGASLPAAGRPGRGWRAPAEGAAWLRRGDRAWVAAGGGLAGGADRRAEGGGGREVSPGPAGWKCLESLFSAWRSLEPSLQGYLSVLSVEEPPWASTWNGVLGASACERSRRCKFLLKAPDAPGPPFPDS

SEQ ID NO: 774877 - protein, 95 aa, Homo sapiens
NVSSCMSFGYKPVWQAKCELQLFWHAGEACAHKQPRSGCACLKVRLYHPGPGWARTQLISPSQKVLPGFNSGHQACPSLASQPALTPQRLENPVP

SEQ ID NO: 774878 - protein, 342 aa, Homo sapiens
MVKEKKKADKKGEKSARSPSSLSDNLDFSKQDGNTTRQEMSPAGVPLLGMQLNEVKPKKDRQNVQQNEDASQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKLEIWKYIRRPVGRQHAPRGGEDEVADHQRRVHRAVGEGHPEWLWNTHMVSKENPQFPFFCLQGRLTFKNGRVYEGAFSNDHIAGFPDLEVEFISCLDLSSGVAPRLSRSAELIRKLDGSESHSVLGSSIELDLNLLLDMYPETVQPEEKKQ

SEQ ID NO: 774879 - protein, 158 aa, Homo sapiens
MASGTGSYKSGNIYEGQWEDNMRHGEGRMRWLTTNEEYTGRWERGIQNGFGTHIMVSKENPQFPFFCLQGRLTFKNGRVYEGAFSNDHIAGFPDLEVEFISCLDLSSGVAPRLSRSAELIRKLDGSESHSVLGSSIELDLNLLLDMYPETVQPEEKKQ

SEQ ID NO: 774880 - protein, 51 aa, Homo sapiens
MAVAPGWPKSPVQLRPPDSRRHHQPGAATWDQAPRSRLPVAGLLSPSTPKH

SEQ ID NO: 774881 - protein, 285 aa, Homo sapiens
RGGRAAAAAAQLRSPRVSLPRAQVGRSASAARMRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKHYAFSENPTVFKYPDFAAGWALSIPLVNKLTKRLKSESLKSDFTIDLKHEIALYIWDKGGGPPLTPVPEFCTNDVDFYCATTFHSFLPLCVSNRRKTSLH

SEQ ID NO: 774882 - protein, 302 aa, Homo sapiens
RGGRAAAAAAQLRSPRVSLPRAQVGRSASAARMRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCVSNRRKTSLH

SEQ ID NO: 774883 - protein, 86 aa, Homo sapiens
ILQTLAKVKHSTGVWALRNSLSNCLPDFITLCWEKVQGTSASHSAGTRAKMPHYGNIFPGSKPYCPDPSCSYLQVPQPVRSSGHWH

SEQ ID NO: 774884 - protein, 251 aa, Homo sapiens
REGAGLPAEGAVRVGSLRSCEFMASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSGESWVCMWG

SEQ ID NO: 774885 - protein, 135 aa, Homo sapiens
AAAYYYYCYCSNSSFKRCTGTCSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPWYETIYSDST

SEQ ID NO: 774886 - protein, 312 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 774887 - protein, 324 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIKPEDTMKAWWPRESYNPRSSWKAEVFR

SEQ ID NO: 774888 - protein, 313 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIKPEDTMKAWWPRESCK

SEQ ID NO: 774889 - protein, 133 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKKVCKLHQTAKEI

SEQ ID NO: 774890 - protein, 246 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGPSLW

SEQ ID NO: 774891 - protein, 312 aa, Homo sapiens; identical to SEQ ID NO: 774886

SEQ ID NO: 774892 - protein, 315 aa, Homo sapiens
RERERERERERERERERERERETRAEFGTKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 774893 - protein, 298 aa, Homo sapiens
GGAGLARPRPGSRGRRARGCSCPAAAEAALAPRDVFLRSRGHGGAAAASRDNSGPRPPPKAASAAATAVPAAGWSCAGLGDRGEAPDSRRGVPLLRGWTSVPGRGIPVSKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 774894 - protein, 257 aa, Homo sapiens
MDHRSRLRGTGLNRIPGTQSRAPRVPLPFHVQQEAREGEDWEREPPRQRPPIYEPPESEELPDNVMVSKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 774895 - protein, 227 aa, Homo sapiens
EELVSRGRAPVRAGVVHAVVAARRRQKRRSRQGTCFCARVVMEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWSVSYTYIRRKKRMDLLLKHGQITLDMI

SEQ ID NO: 774896 - protein, 467 aa, Homo sapiens [sequence omitted]

SEQ ID NO: 774897 - protein, 407 aa, Homo sapiens [sequence omitted]

SEQ ID NO: 774898 - protein, 467 aa, Homo sapiens [sequence omitted]

SEQ ID NO: 774899 - protein, 118 aa, Homo sapiens
RKKKKEKKKKRIEHRKTRVDKNHFSILGYISLSLYTTEISLFQVFYLGFLHLHEIGLQSAFLTLFWSVYGVKIITPLNELESVAFFPVLHKNLRKIGMICLLKVYKAVWPWYLLVGRL

SEQ ID NO: 774900 - protein, 118 aa, Homo sapiens; identical to SEQ ID NO: 774899

SEQ ID NO: 774901 - protein, 101 aa, Homo sapiens
VLSWFETYYCMLHNKFWQENRPDYVNIQLYLSQTDGIQKIIGEKYHALNSRLFLGRPRWKLLFDEIAKYNRGKTVGVFCCGPNSLSKTLHKLRNQNNSYGT

SEQ ID NO: 774902 - protein, 92 aa, Homo sapiens
PSLLPPHTCSHPDQFRFLLVESSLRQGHCAGRAGLGAGGAPGVTPRCPAALHCPPHDAGARAHVSLCQGEIQRREQKSLKRDFFNKAAGGFG

SEQ ID NO: 774903 - protein, 68 aa, Homo sapiens
YRFSWNLRHWATLWTSVASPARPMYNQPPMGKISWKSVVTIWAWIPKCLSAAMATRFFPFMAMMAPPL

SEQ ID NO: 774904 - protein, 103 aa, Homo sapiens
MLCRQQQEFGPSAPRRSRVGKQVRDVAVTQQPPAPRPCVASGLPGAQGKANTAGLGRQGGAQGRTKPGPPKSHRVPDVPGAWRQERVSLKALQATLCLCPCGR

SEQ ID NO: 774905 - protein, 81 aa, Homo sapiens
KTNLLIFWWTSGSPPVLWELPHYLLLSDIFDTLIPVPHPLLLDMYLNDSSFPVHGAYLAYISSSLDSYVAFLLVLPQESGC

SEQ ID NO: 774906 - protein, 74 aa, Homo sapiens
PVRQNNRKQAGFSAMTLTGLSGQGLSRRYLGCGAKGKTVPPGQESCPLCRVTLDRGQRPCIWSVPVPLSPPWSC

SEQ ID NO: 774907 - protein, 68 aa, Homo sapiens
LSSIPGLHPQDTCSSVLPTVTIKYVIRHCPMSPGGNTPLLDFRVKRISAGYPRTSHYRFPGARSRNFA

SEQ ID NO: 774908 - protein, 81 aa, Homo sapiens
AEAGGSATGGSDLRPQGRAGRAGRRVRFPPSERKKSHFPWEELEEVGCLIFTLDLWSRPAGDSPHPPGSHEAGPAQPAGAI

SEQ ID NO: 774909 - protein, 869 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 774910 - protein, 599 aa, Homo sapiens
TLDRGSGCRACGHRNTMKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIAR

SEQ ID NO: 774911 - protein, 924 aa, Homo sapiens
TLDRGSGCRACGHRNTMKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 774912 - protein, 848 aa, Homo sapiens
TLDRGSGCRACGHRNTMKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 774913 - protein, 71 aa, Homo sapiens
LAQGPELVEAEQELDPGLSEASCHLHPDLEQSLRRVATTRDVAALVSGSIAGGCPRQPNSHSSVRSQSEGC

SEQ ID NO: 774914 - protein, 237 aa, Homo sapiens
PQSKGTEWKGSHFPPPMRIGTPTAGPGPSAVMEGCLGVAELRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEY

SEQ ID NO: 774915 - protein, 319 aa, Homo sapiens
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 774916 - protein, 297 aa, Homo sapiens
MLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 774917 - protein, 342 aa, Homo sapiens
RRARSSAGAWSQRPRRRVPGPTMASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQVCNFSATHCREACWLPGALAAPHLCSGWACLCSWNLYP

SEQ ID NO: 774918 - protein, 231 aa, Homo sapiens [sequence omitted]

SEQ ID NO: 774919 - protein, 297 aa, Homo sapiens; identical to SEQ ID NO: 774916

SEQ ID NO: 774920 - protein, 269 aa, Homo sapiens
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVRHVHEGP

SEQ ID NO: 774921 - protein, 265 aa, Homo sapiens
MASSAAGCVVIVGSGVIGRSWAMLFASGGFQVKLYDIEQQQIRNALENIRKEMKLLEQAGSLKGSLSVEEQLSLISGCPNIQEAVEGAMHIQVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 774922 - protein, 239 aa, Homo sapiens
RRARSSAGAWSQRPRRRVPGPTMASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVELASVLG

SEQ ID NO: 774923 - protein, 208 aa, Homo sapiens
RRARSSAGAWSQRPRRRVPGPTMASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHASRGREFSSSSRR

SEQ ID NO: 774924 - protein, 213 aa, Homo sapiens
EGRRAVCLPVSRARGAHPTQGPSGPPRPPGPRAQPMGAGPALPGAEGSQLRRRLVPAPAAPRPRPNHGVLRGRLRGDRWQVKGSEPRCCPWSPGRRRGRGALAWGPRGGRRVAVPAPASGPPKPCALRPLRRWRARGEARLEGLGRWRRPAELGLLPGSQRCRRFRGGPPRPRGLRFLDSVECRRVCPQVHIEVPGTVLNETNSGCDPATTVF

SEQ ID NO: 774925 - protein, 66 aa, Homo sapiens
NTHSDPSLCLSRKEMKLLEQAGSLKGSLSVEEQLSLISGCPNIQEAVEGAMHIQVSEGHWRRICGA

SEQ ID NO: 774926 - protein, 73 aa, Homo sapiens
MISTLKKEKPGTELERGWGCHHLWKRSRKVSLRVCGNGCDLFGEQPGGQCASAQTQVEHAAAGNVPAFNASSH

SEQ ID NO: 774927 - protein, 130 aa, Homo sapiens
MRLRRGRFLISGPWILLLMLECSGLIQGCQLHLLGSSDSPTSASEVSGMTGACPRTWLIFVFLVEAGFHCVGQVCLQLHISSDPFALASKMLLVSWGTACEGKIPNFWPWILLLMLECSGLIQGCQPHHP

SEQ ID NO: 774928 - protein, 84 aa, Homo sapiens
SVRLLELWVPSCHVGGRAHLRMTSTQREVSRAKRPGEMIPDDIIRFLGAAMVELASNVVPGMEVTRGHPHMSADTSSRVIRVPG

SEQ ID NO: 774929 - protein, 147 aa, Homo sapiens
CLKTSLKVLTITNCVLLESDLKHLSQCPSISQLKTLDLSGIRLTNYSLVPLQILLEKVAATLEYLDLDDCGIIDSQVNAILPALSRCFELHTFSFCGNPICMATLENLLSHTIILKNLCLELYPCPPRESYGADGTLCWSKFAQIRA

SEQ ID NO: 774930 - protein, 148 aa, Homo sapiens
PAPVTCPPSFRSPFPLHYPGLEPEPGGAPREWKSLGHAKVDPTQPPAVPSTPQTPPSSEATPRSCGRGPIWTPGSAGSAGRTLLSAAGRGGVRYLPGLPNPLEGASASKWFESGPLLFSRSKKIEQLTSFVCKTSFLASDLCYKVTRA

SEQ ID NO: 774931 - protein, 93 aa, Homo sapiens
ACTSKLDLVERPILYAGEDDRLIGRKDFALCCWAGRVRYLPGLPNPLEGASASKWFESGPLLFSRSKKIEQLTSFVCKTSFLASDLCYKVTRA

SEQ ID NO: 774932 - protein, 68 aa, Homo sapiens
PRAACNSARGGHLESSLLSHLVDPKDLEPRAANCTRVLVWHTRTEKPKMKQEEQLQRQGRGSDPAIEV

SEQ ID NO: 774933 - protein, 138 aa, Homo sapiens
MGDGRPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRTESRCVTQAGVQ

SEQ ID NO: 774934 - protein, 335 aa, Homo sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 774935 - protein, 335 aa, Homo sapiens; identical to SEQ ID NO: 774934

SEQ ID NO: 774936 - protein, 335 aa, Homo sapiens; identical to SEQ ID NO: 774934

SEQ ID NO: 774937 - protein, 342 aa, Homo sapiens
VIQRIPVLPPQTGNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 774938 - protein, 286 aa, Homo sapiens
EGPQETQAVAQEKLSALAGAGKWCLPLFPCAASLPCRLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 774939 - protein, 79 aa, Homo sapiens
DKTRASTLDKPNAQFDSTAPRGHLESSLLSHLVDPKDLEPRAANCTRVLVWHTRTEKPKMKQEEQLQRQGRGSDPAIEV

SEQ ID NO: 774940 - protein, 335 aa, Homo sapiens; identical to SEQ ID NO: 774934

SEQ ID NO: 774941 - protein, 335 aa, Homo sapiens; identical to SEQ ID NO: 774934

SEQ ID NO: 774942 - protein, 293 aa, Homo sapiens
MNLEKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 774943 - protein, 131 aa, Homo sapiens
AGFNGIGLPSRQQRLAWCSVPLAESGEMRAQPAPSRSPFRNPRKEQHDSESLGQQRLHANTTRYIILCAAAGLLAQCAMVHPCCCRTDSAARQLLGITVSQRSFPPVRDLSLTRSSTDSHSTSLSAPRRHS

SEQ ID NO: 774944 - protein, 106 aa, Homo sapiens
ENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 774945 - protein, 248 aa, Homo sapiens
YTTDPQAPSWRFGASSPGGSSDKQGEGAPPMCWRRGHCCWSCYVSKGASEDRRRKRKRGARLGLESCMGNSSNSEQSRPSHSRGPLSPFWAPRVGSEWGHEVLVSKRKEEELALQTVQSRFPGSTHMACRRPCPSITCSFKHSPLSPTTEWAPPVGCALWARLTCPVIGPVASSFPRPPTVPPCQVSHHLMRPLARPVSHPTPDTEPAAASQAPAICPPASALRRRTLLEFHMDPTFSLEPCHTPGHR

SEQ ID NO: 774946 - protein, 44 aa, Homo sapiens
KPHPLSRPIPGSRSGRSPKLLDRRAALCRLPSPGLQSPCSACGT

SEQ ID NO: 774947 - protein, 191 aa, Homo sapiens
RRAARRPAMRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPGSYNLKDFLEQLREKPCSTRGLLSSGEVRFRGLTGNYYPGPGNYGEKGNPYTKLEENA

SEQ ID NO: 774948 - protein, 105 aa, Homo sapiens
LFQSFITSSKHHLGPEYPKHGWVHLHIMLLPLRTSTSLAAEPSTLPSSLVNSSSCRLKSFAKSLTNFTNPESFYYHLHKPKPPLRLVSYLCIVKSTAINMRVQVS

SEQ ID NO: 774949 - protein, 61 aa, Homo sapiens
SVCNDHSALQTSAPCAVLGTVATVATIWLGAGRASHGARISYGRFVFDITDLWLFGLTMDL

SEQ ID NO: 774950 - protein, 67 aa, Homo sapiens
LGVLQVGAVSEAARETQTSEFQGRWRLELGAYRLTPNCLFEWLTGIPAYYAQNLKSPSAFCFSRATL

SEQ ID NO: 774951 - protein, 116 aa, Homo sapiens
MPGLQDPMELCQLNASLESRSSCFQMWSSAVSSASWGLTLGSSSGCEETPNASQNGLSGISPSAFLPPLAIFRVFSLPPLPVSGVFTCSSQKDHLPPALSSVQLHLSTPINRLHSI

SEQ ID NO: 774952 - protein, 504 aa, Homo sapiens
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASAGMILASFATRLLELYLTAGVLTGLGLALNFQPSLIMLGLYFERRRPLANGLAAAGSPVFLSALSPLGQQLLERFGWRGGFLLLGGLLLHCCACGAVMRPPPGPGPRPRRDSAGDRAGDAPGEAEADGAGLQLREASPWVRPRRRLLDLAVCTDRAFAVYAVTKFLMALGLFVPAILLVNYAKDAGVPDTDAAFLLSIVGFVDIVARPACGALAGLARLRPHVPYLFSLALLANGLTDLSSARARSYGALVAFCVAFGLSYGMVGALQFEVLMAAVGAPRFPSALGLVLLVEAAAVLIGPPSAGRLVDALKNYEIIFYLAGSEVALAGVFMAVATNCCLRCAKAAPSGPGTEGGASDTEDAEAEGDSEPLPVVAEEPGNLEALEVLSARGEPTEPEIEARPRLAAESV

SEQ ID NO: 774953 - protein, 504 aa, Homo sapiens; identical to SEQ ID NO: 774952

SEQ ID NO: 774954 - protein, 217 aa, Homo sapiens
GQSERGARRMAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 774955 - protein, 195 aa, Homo sapiens
LYGPEFGMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 774956 - protein, 217 aa, Homo sapiens; identical to SEQ ID NO: 774954

SEQ ID NO: 774957 - protein, 217 aa, Homo sapiens; identical to SEQ ID NO: 774954

SEQ ID NO: 774958 - protein, 112 aa, Homo sapiens
MAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 774959 - protein, 220 aa, Homo sapiens
LYGPEFGMAEVEAPTAAETDMKQYQGSGGVAMDVERSRFPYCVVWTPIPVLTWFFPIIGHMGICTSTGVIRDFAGPYFVSEDNMAFGKPAKCHLQEAFSHPILVRSGCHNKISSIGYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 774960 - protein, 92 aa, Homo sapiens
LYGPEFGMAEVEAPTAAETDMKQYQGSGGVAMDVERSRFPYCVVWTPIPVLTWFFPIIGHMGICTSTGVIRDFAGPYFVSDRPGGQCGQKDS

SEQ ID NO: 774961 - protein, 189 aa, Homo sapiens
GQSERGARRMAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVR

SEQ ID NO: 774962 - protein, 100 aa, Homo sapiens
LYGPEFGMAEVEAPTAAETDMKQYQGSGGVAMDVERSRFPYCVVWTPIPVLTWFFPIIGHMGICTSTGVIRDFAGPYFVSEDNMAFGKPAKLTLLPFGNK

SEQ ID NO: 774963 - protein, 217 aa, Homo sapiens; identical to SEQ ID NO: 774954

SEQ ID NO: 774964 - protein, 217 aa, Homo sapiens; identical to SEQ ID NO: 774954

SEQ ID NO: 774965 - protein, 116 aa, Homo sapiens
PSKCPEPFSPPRYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 774966 - protein, 196 aa, Homo sapiens
GQSERGARRMAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVRSLPRQRD

SEQ ID NO: 774967 - protein, 196 aa, Homo sapiens; identical to SEQ ID NO: 774966

SEQ ID NO: 774968 - protein, 67 aa, Homo sapiens
AVYDIANEDTLQAVANKDTVHNIANEGTIQDITNEGALYDIANDTDKARYADTVHDIANEDTVLRHR

SEQ ID NO: 774969 - protein, 839 aa, Homo sapiens
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWVREYGADVAARDAQGRTALFYARQAGSQLCADILLQHGCPGEGGSAATTPSAATTPSITATPSPRRRSSAASVGRADAPVALV

SEQ ID NO: 774970 - protein, 839 aa, Homo sapiens; identical to SEQ ID NO: 774969

SEQ ID NO: 774971 - protein, 617 aa, Homo sapiens
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAGNKWGAGRGAQLGCRRVGVPPPSPACARASCCPPPSAFPTPTAPLPGARDGHQGGRSWERQPLLELCPLMTPSHPPLRGKL

SEQ ID NO: 774972 - protein, 704 aa, Homo sapiens
ASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAGNKWGAGRGAQLGCRRVGVPPPSPACARASCCPPPSAFPTPTAPLPGARDGHQGGRSWERQPLLELCPLMTPSHPPLRGKL

SEQ ID NO: 774973 - protein, 569 aa, Homo sapiens [sequence omitted]

SEQ ID NO: 774974 - protein, 47 aa, Homo sapiens
MGPEERGSLRFHLLPTEATTPMPSPSPSPSSLQPPPDQTSKHLLKPD

SEQ ID NO: 774975 - protein, 138 aa, Homo sapiens
FSSFFFFLILFFSSVGEGWEDGTALFKSRNFGDRSDFETCPSTAQLGAVTSTEAAPLLPRGQSLLPSSEVWECERIWEGNKDPGENEIAFKEQVGSSFHFQPVKNGQGVSKPHNKSQHQVIHLPLVLMGSVFGLAGEM

SEQ ID NO: 774976 - protein, 839 aa, Homo sapiens; identical to SEQ ID NO: 774969

SEQ ID NO: 774977 - protein, 589 aa, Homo sapiens
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAEENFEFLIVSSTGQTWHFEAASFEERDAWVQAIESQILASLQCCESSKVKVRV

SEQ ID NO: 774978 - protein, 477 aa, Homo sapiens [sequence omitted]

SEQ ID NO: 774979 - protein, 87 aa, Homo sapiens
AAADYYYYYYYFKFAAGRQKLLTVNVVCGNLEAPLSTCFRELNSVIHFLCTVAARLTFYTLLQMNLFVNVMSSYQSIMQSRKGKAEL

SEQ ID NO: 774980 - protein, 90 aa, Homo sapiens
MCWLQAMSISRAGPLVSVVSRVSCRVYLPVGWRIVQEMGTRRSSLCVHCPFAVRGAGWGSHRLPSSPRHECAVVQQTASGRGNSAQKWDG

SEQ ID NO: 774981 - protein, 126 aa, Homo sapiens
PAPGRDPWRRRPPLPADPNFQKAHSFIPGLGVWGWSEEDPPILSCTPSPRGGAGWGTLSSGGDPEEAWAQEERKIFLSPSPPQVSPFPSLPGDNPDLHRQGLLQTHTHAHVFLEEGEKFQENLRWV

SEQ ID NO: 774982 - protein, 313 aa, Homo sapiens
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMND

SEQ ID NO: 774983 - protein, 179 aa, Homo sapiens
RPGVGYCCSRVAGVREKSGEAVGYCSSRMAEFSEEEEDTVRYCCSTIEDVPEEIKEAIAYFCSKMAEINKEPEGNIGHHCYIIPKVTEEVGEASSDMPEPSTSTSQENPSMKWRKKTTCEAKEGETDELLKAAKKIRSFVQQNSERRKAGKKSTVLIFYYHSNKKRDENQPSEDEDSHE

SEQ ID NO: 774984 - protein, 41 aa, Homo sapiens
MPGPAPKPDHHSQPQTCPVSPGQDHTWVRPWSKAREAWLRA

SEQ ID NO: 774985 - protein, 522 aa, Homo sapiens
GSAVARPSVPASGRSPGPSLRSARHAEIRPRLPVRLQPPCTGIWGDPPPAPPVCGPPPQRRCRCGFSAPFTPGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774986 - protein, 336 aa, Homo sapiens [sequence omitted]

SEQ ID NO: 774987 - protein, 302 aa, Homo sapiens
GSAVARPSVPASGRSPGPSLRSARHAEIRPRLPVRLQPPCTGIWGDPPPAPPVCGPPPQRRCRCGFSAPFTPGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKLPVILA

SEQ ID NO: 774988 - protein, 492 aa, Homo sapiens
SGSGITSELTKREEPRTSAAPTELSAGGGGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774989 - protein, 284 aa, Homo sapiens
MGIHHVAQAGLELLGSSNMPASAFQNVGITGVSHHAELRITCFNCWESPFVWAWLSGNLGHKHDPSPSPLTPDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774990 - protein, 535 aa, Homo sapiens
GSAVARPSVPASGRSPGPSLRSARHAEIRPRLPVRLQPPCTGIWGDPPPAPPVCGPPPQRRCRCGFSAPFTPGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774991 - protein, 447 aa, Homo sapiens
SGSGITSELTKREEPRTSAAPTELSAGGGGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDLADSAVPCVVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774992 - protein, 313 aa, Homo sapiens
GSAVARPSVPASGRSPGPSLRSARHAEIRPRLPVRLQPPCTGIWGDPPPAPPVCGPPPQRRCRCGFSAPFTPGASAAAAMARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLVSLLLGSRPHLKASWIES

SEQ ID NO: 774993 - protein, 62 aa, Homo sapiens
GGEGWRSRPDQGEWGGQGDEEGGPFPCRRPHEDVQKWAGTCAEPLRSKLGILEPGSVPVATR

SEQ ID NO: 774994 - protein, 96 aa, Homo sapiens
MRFWKLRALLIVDSLVAVLSPALRKQVRVSFFTSGSENLHRVEKVHWGTRYAITIAFSCNPEHGIEDPAFPVASSWAKVTSGGAVWRQPRQSCTQP

SEQ ID NO: 774995 - protein, 139 aa, Homo sapiens [sequence omitted]

SEQ ID NO: 774996 - protein, 66 aa, Homo sapiens
TSVSHRAQPMNRLLRVISSEAPKEKRRFEILNQNVGKNVNSKAILMRSQMEMRNVWWAMEERPSFL

SEQ ID NO: 774997 - protein, 68 aa, Homo sapiens
FSGSPSGLVMQPLAKQQGALGPWRRAGQGLHCELPESKNHVQLTSVSPASSLCCSENVTWRFLHQVRD

SEQ ID NO: 774998 - protein, 395 aa, Homo sapiens
LSGDLGAGLLVNSPTDQWLHLRRGLNSGCCPRVLRVPREAHTCATLSRVPCVSCRHLLQGASESCLVEQQPPSLSSTAFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 774999 - protein, 395 aa, Homo sapiens; identical to SEQ ID NO: 774998

SEQ ID NO: 775000 - protein, 186 aa, Homo sapiens
LSGDLGAGLLVNSPTDQWLHLRRGLNSGCCPRVLRVPREAHTCATLSRVPCVSCRHLLQGASESCLVEQQPPSLSSTAFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSGKP

SEQ ID NO: 775001 - protein, 161 aa, Homo sapiens
ATCATPAALHRNLGRPAPRPTGLRPSAPAQVQVRLLCPFHPRRIRGGGHGARRRPAGQPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 775002 - protein, 334 aa, Homo sapiens
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 775003 - protein, 370 aa, Homo sapiens
RLQRTLGRERGERGTRRSPGELFPARLPTPWGLPRGARVRWGPQVLAAQTRRSLSRPGPQAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 775004 - protein, 101 aa, Homo sapiens
PELLKKESITNSYAHFQIYNVHYTMSINGKLQDGSMEIDAGNNLETFKMGSGAEEAIAVNDFQNVSIFHAFREFNQASLRDFSNSRRSSVSHTHPNGNCSL

SEQ ID NO: 775005 - protein, 370 aa, Homo sapiens; identical to SEQ ID NO: 775003

SEQ ID NO: 775006 - protein, 191 aa, Homo sapiens
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 775007 - protein, 145 aa, Homo sapiens
MSMNSSSGTKDFSRTVQFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 775008 - protein, 78 aa, Homo sapiens
AWSRTRYAEEIIEAIYKMVGTVIMMKMNEDGLTPEQRVDKIFSKMDKNKDDQITLDEFKEAAKSDPSIVLLLQCDIQK

SEQ ID NO: 775009 - protein, 191 aa, Homo sapiens; identical to SEQ ID NO: 775006

SEQ ID NO: 775010 - protein, 191 aa, Homo sapiens; identical to SEQ ID NO: 775006

SEQ ID NO: 775011 - protein, 191 aa, Homo sapiens; identical to SEQ ID NO: 775006

SEQ ID NO: 775012 - protein, 191 aa, Homo sapiens; identical to SEQ ID NO: 775006

SEQ ID NO: 775013 - protein, 191 aa, Homo sapiens; identical to SEQ ID NO: 775006

SEQ ID NO: 775014 - protein, 45 aa, Homo sapiens
MNSKWIKDLKVRAKTIIKLLGENIREELHEIGFGNDFLDTTPSIG

SEQ ID NO: 775015 - protein, 223 aa, Homo sapiens
AGTSEGARRLRPPVPADAAGDMSSPDGPSFPSGPLSGGASPSGDEGFFPFVLERRDSFLGGGPGPEEPEDLALQLEQKEKDLLLAAELGKMLLERNEELRRQLETLSAQHLEREERLQQENHELRRGLAARGAEWEARAVELEGDVEALRAQLGEQRSEQQDSGRERARALSELSEQNLRLSQQLAQASQTEQELQRELDALRGQCQAQALAGAELRTRLESL

SEQ ID NO: 775016 - protein, 152 aa, Homo sapiens
SNRKQAAVRVTAVLQTRCGEGLVQSPGSRSRVAEPQRVAPGQRVNANPALQEAPPLRRRLLGGKKAPALCGRYAEARGGRRLALPRRWETVFAAATGRPAACTGISVSRGCREGALGGPPAASKASQPEAAGWRPGFTLRKVLTKDLRFLRF

SEQ ID NO: 775017 - protein, 223 aa, Homo sapiens
LRVFLPARPLSRVLLLPDSGSFFPCGPSPELFSLRTLGLSPHAAPLPSSPSRLRVFPRTAPPPSSSPSRLQFFLPARPLSRVLLLPDSRSFSPRGPSPEFFSFRTPGLSPLAAPLPSSSCSGLRVFLPARPLSRALLAPDSGSFSPRGPSPEFFSFRTPGLSPRAAPLPSCSPSGLRVFLPARPLSRVVLAPDSGSFSPRGPSPEFFSFRTPGLSPHGLSPEF

SEQ ID NO: 775018 - protein, 105 aa, Homo sapiens
MCACNLLFLAFNCKILRLRAESQPGRMLPCKEQGCCPPLLTLPLHLHGKCLMLRIPGVCSCRVAGMMSYFQSRQLPLLAWSGELQFECLESVNLRQPNSVTFSNF

SEQ ID NO: 775019 - protein, 96 aa, Homo sapiens
TSHLPETEGFLRLWTFNAKTRNIRGKAGCVVRLCGARQCVAQGKLRFMEASRRLPCKARQVASSAIPASAPASALRPIQCLEPTGVSRQVCVITTQ

SEQ ID NO: 775020 - protein, 96 aa, Homo sapiens; identical to SEQ ID NO: 775019

SEQ ID NO: 775021 - protein, 138 aa, Homo sapiens
MLAEARPPPDASRVSGKESALPRLPRHLQQEQLSLWLWGAPLLQTQKGCAFGSQTLSMRLPSLVLWTKQTVEWLLGVCIKGQTVAFTLCTITPLLHSPYPFFNLFVSGELLIRLLCLLMICHVILKVILFSYGQEKRK

SEQ ID NO: 775022 - protein, 755 aa, Homo sapiens
GVSRARQQGPEEGGQRPKGQRRDTEKKRDQPQRDKDPNVCPHCRRGSWSQCCLSVPMGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 775023 - protein, 724 aa, Homo sapiens
GVSRARQQGPEEGGQRPKGQRRDTEKKRDQPQRDKDPNVCPHCRRGSWSQCCLSVPMGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSCVATAPSAIDALNVRAVTVMRRTWVSTATSARALADMLETPEP

SEQ ID NO: 775024 - protein, 175 aa, Homo sapiens
GNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 775025 - protein, 37 aa, Homo sapiens
MRAAGLLPLPLLVRPTGPVHIRGPSGLSEAMQAPSVW

SEQ ID NO: 775026 - protein, 137 aa, Homo sapiens
QVRENCARILAVLLNSYIPLDKLRALSLSFLTCIKGEIIPVKRAKMRLKCREPGVLLVPSTCQCLVAALAAVTALMMPCCLGYSWSEILKRSTERRVWNRKRNVVFFSYHTLVRLLVSGVLRKETSCFKASQSVLPP

SEQ ID NO: 775027 - protein, 103 aa, Homo sapiens
MHKTRQRKSRSLTVWCAHQPCHLWTLQMRGINFSLSHYYFEGLCDMQPNSHTFLLPVLSAPIPQPQHAAAPGPLGLGPGHTQHLCLSSQTFSGPSCPRVSRRA

SEQ ID NO: 775028 - protein, 86 aa, Homo sapiens
NCQPPELEEPIYKERCHVSSGEPGPSEGLAGPSQCDPAPMGSLFPPAQPWGAGVPLEGNSFQRLKGLQGHVNPASQVYPQNQQFYQ

SEQ ID NO: 775029 - protein, 210 aa, Homo sapiens
MGCESYLVPLILLGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPSRTRMRGKKVPPVRG

SEQ ID NO: 775030 - protein, 116 aa, Homo sapiens
CDYACGRARASFGGGSLSRRRPLAPGPAGSRRWARAVPGACGSLRAVDPRGLPAFLTPAAWRPRELHLPSIRIAQLLPRAPAAFAPQAPAETARKAGSSTPDHKRCLGTKGGRGPG

SEQ ID NO: 775031 - protein, 58 aa, Homo sapiens
EGPIRSIGSRDYGGGGPPAGFLRGGDPGTGVTGLGPSPKASEPGKQWCDLQSKAKGLR

SEQ ID NO: 775032 - protein, 114 aa, Homo sapiens
HLWSLSLSFPDNPALVLSESGTWPSILGWLSSTPLSVLIFYIFHPSAFLIPLLPSSLAFLGYICLLCKYNTGPGLEFQPHPIPHILSSSPSISVSLSHFEKLGISEGNRGWVVY

SEQ ID NO: 775033 - protein, 105 aa, Homo sapiens
MLGEHKVLTPKNNLANSTGTKLKKFQEESDFKPAKKTFGVNTVYGAKALNPLWRDGFLDFEKLLKNKITQYEKSLYICKFGVSLDGDVCLFLEVDDLKKITDALQ

SEQ ID NO: 775034 - protein, 127 aa, Homo sapiens
IRLEALLPSNDPTSPLVTSPTYLRLQPNKMSSSSSFKGYAISLEGRSGSAQRASLPYSLPFYPTNSSFGVQSELRYNSLLEPFLDLSSAHFHNTEIYSFVAFFIIVLKLPGYSLTLSRFKILQTKKC

SEQ ID NO: 775035 - protein, 490 aa, Homo sapiens
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQEKKKKHSL

SEQ ID NO: 775036 - protein, 302 aa, Homo sapiens
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLSKYILQSKGKTFGILAYIWKLGNFNMYT

SEQ ID NO: 775037 - protein, 224 aa, Homo sapiens
MSLLIFLTAQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQEKKKKHSL

SEQ ID NO: 775038 - protein, 788 aa, Homo sapiens
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 775039 - protein, 788 aa, Homo sapiens; identical to SEQ ID NO: 775038

SEQ ID NO: 775040 - protein, 116 aa, Homo sapiens
RCSLQGSHLLMVAIQMSIFLKSRTPSCHLPLDHPPPGALLSALFPPLLWSFPGPDLPPSCTTAFHGVNPLWLPIAIGLMFRAVPQTGHCWLLPPHLLGLLHTQGMPQATIYLSGTT

SEQ ID NO: 775041 - protein, 73 aa, Homo sapiens
RESPEQRAGQTSSGPPALRSPETPGLLKGSACPPLALSSLWRPGWQDLSAQPFRLVTSRVSLCVSGWSTVVQL

SEQ ID NO: 775042 - protein, 157 aa, Homo sapiens
MRNVNHQDNVENVCRACQRTSRQPLPSQAQGLGGKNGSMGLGQAQGPSALCSLGTWYPASQLLQLQQWLKGAKVQLGPLLQRVQALLTGGFHIVLSLWVHRSQELRYRNLYLDFRACMETAGCPGRSLLQGWSPHGEHLLGQYRREMWGRGPHTESP

SEQ ID NO: 775043 - protein, 221 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 775044 - protein, 221 aa, Homo sapiens; identical to SEQ ID NO: 775043

SEQ ID NO: 775045 - protein, 221 aa, Homo sapiens; identical to SEQ ID NO: 775043

SEQ ID NO: 775046 - protein, 221 aa, Homo sapiens; identical to SEQ ID NO: 775043

SEQ ID NO: 775047 - protein, 221 aa, Homo sapiens; identical to SEQ ID NO: 775043

SEQ ID NO: 775048 - protein, 221 aa, Homo sapiens; identical to SEQ ID NO: 775043

SEQ ID NO: 775049 - protein, 221 aa, Homo sapiens; identical to SEQ ID NO: 775043

SEQ ID NO: 775050 - protein, 221 aa, Homo sapiens; identical to SEQ ID NO: 775043

SEQ ID NO: 775051 - protein, 211 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLDVFWQRPSCIYEFSLKKQENTCRK

SEQ ID NO: 775052 - protein, 190 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLVHL

SEQ ID NO: 775053 - protein, 221 aa, Homo sapiens; identical to SEQ ID NO: 775043

SEQ ID NO: 775054 - protein, 221 aa, Homo sapiens; identical to SEQ ID NO: 775043

SEQ ID NO: 775055 - protein, 154 aa, Homo sapiens
MKKSLENLNRLQVMLLHLTAAFLQRAQDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 775056 - protein, 109 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDVHL

SEQ ID NO: 775057 - protein, 221 aa, Homo sapiens; identical to SEQ ID NO: 775043

SEQ ID NO: 775058 - protein, 221 aa, Homo sapiens; identical to SEQ ID NO: 775043

SEQ ID NO: 775059 - protein, 240 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLEDLSIMQKFGRCQKLSQISPGPEFSLFIKDVFWQRPSCIYEFSLKKQENTCRK

SEQ ID NO: 775060 - protein, 240 aa, Homo sapiens; identical to SEQ ID NO: 775059

SEQ ID NO: 775061 - protein, 221 aa, Homo sapiens; identical to SEQ ID NO: 775043

SEQ ID NO: 775062 - protein, 150 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRFSTYFPGYFDGQYWLWWVFLVLGFLLFLRGFINYAKVRKMPETFSNLPRTRVLFIY

SEQ ID NO: 775063 - protein, 111 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRMTILGVGMNLHQLHILG

SEQ ID NO: 775064 - protein, 53 aa, Homo sapiens
SLDRPQGMGSELQPGHLKVPGHRGGLHGHPGHVRLRRGCYQEAPGLGSSQGAH

SEQ ID NO: 775065 - protein, 136 aa, Homo sapiens [sequence omitted]

SEQ ID NO: 775066 - protein, 221 aa, Homo sapiens
GGGTADGGGSVLGRCALQATPALLNQHPPFSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVH

SEQ ID NO: 775067 - protein, 478 aa, Homo sapiens
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 775068 - protein, 478 aa, Homo sapiens; identical to SEQ ID NO: 775067

SEQ ID NO: 775069 - protein, 478 aa, Homo sapiens; identical to SEQ ID NO: 775067

SEQ ID NO: 775070 - protein, 478 aa, Homo sapiens; identical to SEQ ID NO: 775067

SEQ ID NO: 775071 - protein, 108 aa, Homo sapiens
MWFSQPDYIQAGMMRTARRPTGSASPVGLGPSRQSSDGFCIKFKDPAWWLLLCSPSEAWKLVFPACVTDGPSPTFVKKNLHFDESTVLLAFCNSIETHCHSLITAEDD

SEQ ID NO: 775072 - protein, 107 aa, Homo sapiens
YILEQPSALMGGSRWISGLAFLLLGGYNSGLDAAPSPRVPSSLGPQLPTTAYPLGTCSVTWLASLFLDSRPHSLLVFPRITYQINNFYRISCLKACIGETQPNAVSR

SEQ ID NO: 775073 - protein, 49 aa, Homo sapiens
MWASPRLLLGPPASVAHSEHLLPTQFPARWVRGLECLLLLLLFPGWKRR

SEQ ID NO: 775074 - protein, 75 aa, Homo sapiens
GHGDDVDTDDEGDEEVEIVAGAQRVNGAARGRVVGIVGPALGLCGEGGHERRAGGPPGAPGSCRLHSPPRWPSVG

SEQ ID NO: 775075 - protein, 96 aa, Homo sapiens
GSAIVSYYGEEEKDLVLNSVLMEVEEPEVLQDSLDGCYSTQSMYFELPDSFQHYRSVFYSFEEEHISFALYLDNRFFTLTVTSLHLVFQMLVIFPQ

SEQ ID NO: 775076 - protein, 46 aa, Homo sapiens
TTFPPLFAGVVVTKDCRTLPRGSQECGWCGVDRHCRPQIRVRGSGA

SEQ ID NO: 775077 - protein, 120 aa, Homo sapiens
QLSFIPAPSQSAEQRSEGHLCPVRNEPLWSCWSQVPSDWGCEPSLPDLGPSSGTPLPSAESIIDEVPAVRRIPAESPGHHWQPSQEAKLLGQDELVPEDRASELCQAVASSEQRPSVPSG

SEQ ID NO: 775078 - protein, 100 aa, Homo sapiens
MLHETFLNTHHPIKNRKGNPTVSPTLIPLSAPPWASLLPRVFREKGQSTALSNWASGDVAWLPGWATSSTVSKWHCPYSTSSSTARNECPDCKERSPATL

SEQ ID NO: 775079 - protein, 105 aa, Homo sapiens
TSSPYSLQCRPPRGTVACRLTHRSQALGLRRQAGPGVTPSPPPGKGAIEAHGTSIWVLIHKMGMAPSTPGMSAKMKHSIRPQGAGNKRPQPHFLFWPCGDAALPT

SEQ ID NO: 775080 - protein, 112 aa, Homo sapiens
MALLTPGFWTSSLQNTAEQIPLAAVPHYHKLGGLKQQMFSFSCGIQKPHIKMSAELVPSGDSAGVSHASLPASGAASNPWHSSASRCVISISASIFTWPPSLCGSVHPLFFS

SEQ ID NO: 775081 - protein, 187 aa, Homo sapiens [sequence omitted]

SEQ ID NO: 775082 - protein, 196 aa, Homo sapiens
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 775083 - protein, 227 aa, Homo sapiens
MPFSWVGKTKSVSSLKQLSLVNVSVIKHLSSPWSVWLCKRMLNTYIFNKSCKGLKQQQHNTTTNKHNKHNTHNKNRTTTTNNKKDKTTTHEATTDATKRTTATQQPPPTARARQVWGQRDGGDTTTRENTAELPCGRQEGRSTTASNTRRRERRKGTDSGGGARHPTPDRTEMDKKTTPARGGQAPNGASGSQREDEDQPLTEGGQAYEHEEEQHEGERSQQHEPAA

SEQ ID NO: 775084 - protein, 196 aa, Homo sapiens; identical to SEQ ID NO: 775082

SEQ ID NO: 775085 - protein, 67 aa, Homo sapiens
ERVMRLGEEAEPADRSQEQHPGGRPLGRRQRWQRDLNPEPEPESEEPDGGFRTLYAELRRENERLRE

SEQ ID NO: 775086 - protein, 198 aa, Homo sapiens
MLMTTCKGTPVPLWEEDSHRRKLMNNVKKCHTCPVRRNDVCYRTSTEEGMPAWSEEAHGKGQKSQRPSTGNFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRE

SEQ ID NO: 775087 - protein, 69 aa, Homo sapiens
RNPTSPHAPPQQPSASAGQSGRCLSGPQTWLSHRTCHTSSRGHNAHYHLPHGNVSSNRLINKASSAAQA

SEQ ID NO: 775088 - protein, 163 aa, Homo sapiens
DEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKY

SEQ ID NO: 775089 - protein, 36 aa, Homo sapiens
SQAGMDFCSLVSVLPQYTVSRASCRLWGALGKVCVE

SEQ ID NO: 775090 - protein, 127 aa, Homo sapiens
RGGGKEAAARLCPLTVGASATPASPHPQGTSKDDDGLWGVRAEVGGRGRSRGGPGATPGAPSPATPSPSARARPGLEPEPAARQPSAAARQPRAAEGAGGAAGRGSAAAAVNSGPALQRTPSSCTGH

SEQ ID NO: 775091 - protein, 86 aa, Homo sapiens
RGGGKEAAARLCPLTVGASATPASPHPQGTSKDDDGLWGVRAEVGGRGRSRGGPGATPGAPSPATPSPSVNSGPALQRTPSSCTGH

SEQ ID NO: 775092 - protein, 253 aa, Homo sapiens
MMMGCGESELKSADGEEAAAVPGPPPEPQVPQLRAPVPEPGLDLSLSPRPDSPQPRHGSPGRRKGRAERRGAARQRRQVRFRLTPPSPVRSEPQPAVPQELEMPVLKSSLALGLELRAAAGSHFDAAKAVEEQLRKSFQIRCGLEESVSEGLNVPRSKRLFRDLVSLQVPEEQVLNAALREKLALLPPQARAPHPKEPPGPGPDMTILCDPETLFYESPHLTLDGLPPLRLQLRPRPSEDTFLMHRTLRRWEA

SEQ ID NO: 775093 - protein, 178 aa, Homo sapiens [sequence omitted]

SEQ ID NO: 775094 - protein, 276 aa, Homo sapiens
MGCGESELKSADGEEAAAVPGPPPEPQVPQLRAPVPEPGLDLSLSPRPDSPQPRHGSPGRRKGRAERRGAARQRRQVSGGGWPPARDGLRPPGHCPALCSQVRFRLTPPSPVRSEPQPAVPQELEMPVLKSSLALGLELRAAAGSHFDAAKAVEEQLRKSFQIRCGLEESVSEGLNVPRSKRLFRDLVSLQVPEEQVLNAALREKLALLPPQARAPHPKEPPGPGPDMTILCDPETLFYESPHLTLDGLPPLRLQLRPRPSEDTFLMHRTLRRWEA

SEQ ID NO: 775095 - protein, 178 aa, Homo sapiens [sequence omitted]

SEQ ID NO: 775096 - protein, 161 aa, Homo sapiens
MGCGESELKSADGEEAAAVPGPPPEPQVPQLRAPVPEPGLDLSLSPRPDSPQPRHGSPGRRKGRAERRGAARQRRQVRFRLTPPSPVRSEPQPAVPQELEMPVLKSSLALGLELRAAAGSHFDAAKAVEEQLRKSFQIRCGLEESVSEGATWAWARHDHLV

SEQ ID NO: 775097 - protein, 178 aa, Homo sapiens [sequence omitted]

SEQ ID NO: 775098 - protein, 147 aa, Homo sapiens
MGCGESELKSADGEEAAAVPGPPPEPQVPQLRAPVPEPGLDLSLSPRPDSPQPRHGSPGRRKGRAERRGAARQRRQVSGGGWPPARDGLAPTWSLPCPLLPGPLPPDAALPGAVRAAACGAAGAGDARAEEQPGLGPGAAGRSREPL

SEQ ID NO: 775099 - protein, 220 aa, Homo sapiens
TIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKGNV

SEQ ID NO: 775100 - protein, 254 aa, Homo sapiens
VTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSL

SEQ ID NO: 775101 - protein, 31 aa, Homo sapiens
PGYNGKGSTGPALTEEMDNNQHLCASGTNED

SEQ ID NO: 775102 - protein, 112 aa, Homo sapiens
LWVPGGPLRDSRKTTFSLAAAGEGEVEDCCSVPYPKETQGSRQNRLDIFTFSSQGHRSPNQQPLRVVSGRPFPWQRISAPRDIPHLGHPQRLCRDSSTTIAEVLGILEITCW

SEQ ID NO: 775103 - protein, 36 aa, Homo sapiens
KHHCLKALVPTTNQTGSGEASKSVHRLAEVQRKTLT

SEQ ID NO: 775104 - protein, 258 aa, Homo sapiens [sequence omitted]

SEQ ID NO: 775105 - protein, 129 aa, Homo sapiens
MMSSQFTQWTCLLQRRPRLNGRRAGGCGCCSLQSPPGLRHVGYAHVGVGVLWVGWPLLRPPGPCGDSPLQRRCPQLSSYCGPLRRRSILSGTMRRKHLLRQKQAPPPGASWRSLAQWWTSSLMRDYHQF

SEQ ID NO: 775106 - protein, 130 aa, Homo sapiens
EGFVVLQKVHPTQDGNDILEGFVVLQDLLHPTGNIVNIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775107 - protein, 113 aa, Homo sapiens
SGPELRDIEKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775108 - protein, 258 aa, Homo sapiens [sequence omitted]

SEQ ID NO: 775109 - protein, 180 aa, Homo sapiens
PRVAHASVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775110 - protein, 133 aa, Homo sapiens
MPVLIGRGIRPCWGWGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTERLG

SEQ ID NO: 775111 - protein, 101 aa, Homo sapiens
TLRLGTRLVCNRTRYAHVGVGVLWVGWPLLRPPGPCGDSPLQRRCPQLSSYCGPLRRRSILSGTMRRKHLLRQKQAPPPGASWRSLAQWWTSSLMRDYHQF

SEQ ID NO: 775112 - protein, 145 aa, Homo sapiens
AWDYDSGTKSGWYGRNSRDILRPCWGWGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTERLG

SEQ ID NO: 775113 - protein, 135 aa, Homo sapiens
KLGLGTRLGVVRPCWGWGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTERLG

SEQ ID NO: 775114 - protein, 258 aa, Homo sapiens [sequence omitted]

SEQ ID NO: 775115 - protein, 258 aa, Homo sapiens [sequence omitted]

SEQ ID NO: 775116 - protein, 258 aa, Homo sapiens [sequence omitted]

SEQ ID NO: 775117 - protein, 258 aa, Homo sapiens [sequence omitted]

SEQ ID NO: 775118 - protein, 258 aa, Homo sapiens [sequence omitted]

SEQ ID NO: 775119 - protein, 258 aa, Homo sapiens [sequence omitted]

SEQ ID NO: 775120 - protein, 239 aa, Homo sapiens
MNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAVTLTSPEKPLLVDH

SEQ ID NO: 775121 - protein, 230 aa, Homo sapiens
MNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQTTIPPGYQCILGMDELSGETGDRSRAGNTAFLVSNQGEAKHWEGLRENRVQMGERHKAMAQEDNRTRAGAPN

SEQ ID NO: 775122 - protein, 258 aa, Homo sapiens [sequence omitted]

SEQ ID NO: 775123 - protein, 155 aa, Homo sapiens
ILSSAHVNMKIRVKNDFIMGKRDRMQIVQILRPCWGWGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTERLG

SEQ ID NO: 775124 - protein, 259 aa, Homo sapiens
MPPLRTGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775125 - protein, 258 aa, Homo sapiens [sequence omitted]

SEQ ID NO: 775126 - protein, 187 aa, Homo sapiens
MNEPPGARARVALTGLTVAEYFRDQEGQDVLLFIDNIFRFTQAGSEVSALLGRIPSAVGYQPTLATDMGTMQERITTTKKGSITSVQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775127 - protein, 155 aa, Homo sapiens; identical to SEQ ID NO: 775123

SEQ ID NO: 775128 - protein, 258 aa, Homo sapiens [sequence omitted]

SEQ ID NO: 775129 - protein, 188 aa, Homo sapiens
MQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 775130 - protein, 155 aa, Homo sapiens; identical to SEQ ID NO: 775123

SEQ ID NO: 775131 - protein, 155 aa, Homo sapiens; identical to SEQ ID NO: 775123

SEQ ID NO: 775132 - protein, 155 aa, Homo sapiens; identical to SEQ ID NO: 775123

SEQ ID NO: 775133 - protein, 155 aa, Homo sapiens; identical to SEQ ID NO: 775123

SEQ ID NO: 775134 - protein, 155 aa, Homo sapiens; identical to SEQ ID NO: 775123

SEQ ID NO: 775135 - protein, 155 aa, Homo sapiens; identical to SEQ ID NO: 775123

SEQ ID NO: 775136 - protein, 155 aa, Homo sapiens; identical to SEQ ID NO: 775123

SEQ ID NO: 775137 - protein, 155 aa, Homo sapiens; identical to SEQ ID NO: 775123

SEQ ID NO: 775138 - protein, 155 aa, Homo sapiens; identical to SEQ ID NO: 775123

SEQ ID NO: 775139 - protein, 155 aa, Homo sapiens; identical to SEQ ID NO: 775123

SEQ ID NO: 775140 - protein, 79 aa, Homo sapiens
LPRLFGFGFAFTSLFCFVLAWLIVLCCALLFFLFSGFLIGCSSILAGEYDHLPEQAFYMVGPIEEAVAKADKLAEEHSS

SEQ ID NO: 775141 - protein, 141 aa, Homo sapiens
RGGGKPKTKARYEAGWLRPCWGWGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTERLG

SEQ ID NO: 775142 - protein, 258 aa, Homo sapiens [sequence omitted]

SEQ ID NO: 775143 - protein, 258 aa, Homo sapiens [sequence omitted]

SEQ ID NO: 775144 - protein, 258 aa, Homo sapiens [sequence omitted]

SEQ ID NO: 775145 - protein, 258 aa, Homo sapiens [sequence omitted]

SEQ ID NO: 775146 - protein, 258 aa, Homo sapiens [sequence omitted]

SEQ ID NO: 775147 - protein, 288 aa, Homo sapiens
MNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVDRNLAVFIFVLVSLICGVQKASFFCVGCTRALIEDIFFLNSI

SEQ ID NO: 775148 - protein, 155 aa, Homo sapiens; identical to SEQ ID NO: 775123

SEQ ID NO: 775149 - protein, 258 aa, Homo sapiens [sequence omitted]

SEQ ID NO: 775150 - protein, 187 aa, Homo sapiens; identical to SEQ ID NO: 775126

SEQ ID NO: 775151 - protein, 155 aa, Homo sapiens; identical to SEQ ID NO: 775123

SEQ ID NO: 775152 - protein, 247 aa, Homo sapiens
GTDGPGGRGGSRVVGAELRRRRGRGGKGRPQLGRARLAAGNRVSPRFSSGVRARDPISGLSRASPARWSPRWDCGVLAEQPELHFFLSGRSCLKHAYLHLLLLRTELTEAVFFPPRPCRPIDPAAARATQGGPTHRRLGPLGSKPPLPSRGPAHPPHSHSQRSLPPASGEKRNFHFPPAKLHTCSLHHRAPPPTFCFSSIAESDPLLPLDWNPYPRHFIIPRFSTPRTLAATLFYFPSLKLVKEAPA

SEQ ID NO: 775153 - protein, 149 aa, Homo sapiens
QLQGFLRKAPSTFIHLRRVLQIPLENQLQVLPILMLPNETHEEVNDGVGTAVKRRQENGRQMNMRIYDFPVHVDPGKQGPLNANGQAAEEEDQHCEQMVMYSLVSGIFWDPQRILTTRTRLDTQRTTNKKISHVTVMNLMFDTKQNQHH

SEQ ID NO: 775154 - protein, 105 aa, Homo sapiens
MTPLLLFMASYPPRIQTSNSFLLPQSPSRPCLMRSPGSLRSCPIESLPVFLKWLQAPIHPIRKTKGFSLFVFFPALPQCLQQCQVHNKFANMTIKGLWIFIINII

SEQ ID NO: 775155 - protein, 370 aa, Homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 775156 - protein, 852 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 775157 - protein, 852 aa, Homo sapiens; identical to SEQ ID NO: 775156

SEQ ID NO: 775158 - protein, 183 aa, Homo sapiens [sequence omitted]

SEQ ID NO: 775159 - protein, 725 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNGRSLHPARQA

SEQ ID NO: 775160 - protein, 85 aa, Homo sapiens
IINPKNFFLSLQVGGIKDKVLAAHRAGLKQVIIPRRNEKDLEGIPGNVRQDLSFVTASCLDEVLNAAFDGGFTVKTRPGLLNSKL

SEQ ID NO: 775161 - protein, 792 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVSMKKQFIWLFFI

SEQ ID NO: 775162 - protein, 224 aa, Homo sapiens
RLGTRLGLNRPRPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 775163 - protein, 832 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLELSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 775164 - protein, 852 aa, Homo sapiens; identical to SEQ ID NO: 775156

SEQ ID NO: 775165 - protein, 852 aa, Homo sapiens; identical to SEQ ID NO: 775156

SEQ ID NO: 775166 - protein, 68 aa, Homo sapiens
VVVVAAAVVVVVVATVVVVAMVVGATVGMMGTVVASVVAAMAVASVLLTAPVAPTVVGGNVGGAEREM

SEQ ID NO: 775167 - protein, 97 aa, Homo sapiens
GIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 775168 - protein, 41 aa, Homo sapiens
MKHRTTDENNKLKSSKDEYMQSGSKNKEKKTKDKQVEKEET

SEQ ID NO: 775169 - protein, 97 aa, Homo sapiens; identical to SEQ ID NO: 775167

SEQ ID NO: 775170 - protein, 97 aa, Homo sapiens; identical to SEQ ID NO: 775167

SEQ ID NO: 775171 - protein, 260 aa, Homo sapiens
MCANLPPGILRVSSTSLHPGTTHAGGLGILTASAARAFRGKRTGDSGDSRHLQSHSLKTEPHALLDIKAMRSLVDRIPSKHFPKPEGLLTRLCPSPPTWLIWDHISTWPDSSTRMPSKTNTDALVTLTREAGGAPTWLLHLDVGNGGSKNVRKPRPGKCQPKSRHSLPQTQKPEEVRKCGGICLPVCLQDPGACPSWLPLEEGLRRPAFGHRTEAGPRGKGFGRHRGNSGLRAAEVTHGPCWEAADVPCLRLTKPHGLRV

SEQ ID NO: 775172 - protein, 105 aa, Homo sapiens
LEEKTLAVQNLTGWRGKGRGWPEAASVAQRSGLLARQRALRKHLPHLRHTQRRRRGPGLFLTRSPADPVAVRGRKRGRQLLGDAGVTEQGPRSLTTEEKRQPFYY

SEQ ID NO: 775173 - protein, 73 aa, Homo sapiens
FSLSQGLTLSPRLGLVSTHAMESSSWSGVDRVGVEDLLPHRCSVSYLTYGQQLSSPECVHTGVSAPWAVMDEG

SEQ ID NO: 775174 - protein, 109 aa, Homo sapiens
HIPSPISSSQSCPLCFSFVILATIYFPSKQNCHQEPLRCVASTSSPRWLFNSLPLGHRTNTPLEPPIEVTNQLTKSNNDFSVLILSNFPVTFVIPSVKGRTGTPKIYTP

SEQ ID NO: 775175 - protein, 126 aa, Homo sapiens
SDLKEYTKEQDKPSNLVLKDKVSPNEEAKYNVVLDEQAEDSKSSHSHTSKNHKKKTHHCSEVKEDEDYIPIKNINPDKYEKVWSLVTTKKKKAVGRNERVKRETELRTEVVADRKRGMAIIVIVTN

SEQ ID NO: 775176 - protein, 148 aa, Homo sapiens
MAGRAVLLAGPPGTGKTALALAIAQELGSKVPFCPMVGSEVYSTEIKKTEVLMENFRRAIGLRIKETKEVYEGEVTELTSCETENPMGGYGKTISHVIIGLKTAKGTKQLKLDPSIFESLQKERVEAGDVIYIEANSGAVKRQGRCDS

SEQ ID NO: 775177 - protein, 63 aa, Homo sapiens
SLSTDTSAHSKAGSSSPEPWARPSCTPQEGGCPRPKERESPPPSALQPVQLPRLALSPPPPAP

SEQ ID NO: 775178 - protein, 69 aa, Homo sapiens
ERAEIEKRRERSMKCREISVFNGEREKEESKKSDYRPGTVADICNPSTLGGRGGSEPRLPLLSSAWLTY

SEQ ID NO: 775179 - protein, 136 aa, Homo sapiens [sequence omitted]

SEQ ID NO: 775180 - protein, 94 aa, Homo sapiens
PALTRLWVQGPFDGPCGEKEAAGDRHVSQANVCPGYAEQPLPSKPDPGWSKEGAAVASAGPESSTPAPPGVPSAAATGTRGRRNPGCGWWQDQG

SEQ ID NO: 775181 - protein, 70 aa, Homo sapiens
DSDHPLVLLSKTAKTRHRNSQPPDPHAPPGSTRLPNLASSAPNLPIPFLGRPRREQSWHQEANNPGPLRP

SEQ ID NO: 775182 - protein, 42 aa, Homo sapiens
TGAQQIASSYPQTVFACMQPLALPLYGRKPAQGHTAGQQQRS

SEQ ID NO: 775183 - protein, 131 aa, Homo sapiens
MERGAALAAPQSALAQPCPGHPPLLELRSGAPSSWLHPRRLPCDGVPYLGCAQSFLAAQQGRGWDARSWSESSGTPWTSLVPTMTGCLDKATSHLQVLQGQPPVGWAPARVGAAVARAQVAQTLALLLLLV

SEQ ID NO: 775184 - protein, 115 aa, Homo sapiens [sequence omitted]

SEQ ID NO: 775185 - protein, 122 aa, Homo sapiens
RRRVLDRRTLSGSVYFASTSVPPRPGAAPGHILVLSRLQPLCAEVSRSHGRVILCEVYQACAQGNQDEEICLRLTVHANIEHFLLVSVINKGFDIVRRDGKKVSRSELKPLPLRTLSRSLAS

SEQ ID NO: 775186 - protein, 115 aa, Homo sapiens [sequence omitted]

SEQ ID NO: 775187 - protein, 99 aa, Homo sapiens
AFVSSPKCVILQTEVTPDAEISIPPRSPHAACHSHAHFSAWKPLYICAPFSFVILSTFYGQDLAICDLGDWLLSPSFPADPCRVLSLLIPSSICPLPFN

SEQ ID NO: 775188 - protein, 170 aa, Homo sapiens
MEQIFLFHLFLIAPVPAEDRTLSSFLPASGRWQGVLCVPTKERAVPAPESLSEPCHGRHPGECGTPHPLSQNRGASMTLRITALRGMYQLQVSAFVRVLHCHVAPPDVIAKMPVDKPGLGPSCWQSGGSRALFLQLTQSQDWLSFAQLVQNLIVLMLNIYHQCSMLQLQT

SEQ ID NO: 775189 - protein, 144 aa, Homo sapiens
MRAEEPCAPGAPSALGAQRTPGPELRLSSQLLPELCTFVVRVLFYLGPVYLAGYLGLSITWLLLGALLWMWWRRNRRGKLGRLAAASSNSLTMNASSSAASCGASTCQPGSTSRTWSGSSGPTRSSLRPALPKHDHGKAVPGET

SEQ ID NO: 775190 - protein, 256 aa, Homo sapiens
MEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAQWHAREVAIGQYLHSDVGPHGRALVLEGWPFHTQRQCPTGEEMMSCCQVGSNTSMASGSVNQGRYTRWIEPEGTWVDMMRCPHLARHQDETQWTGWRDGEGLRSESSRYSAHPPTHVPERGLGKVRFLRMEHTRSSGKFLPLVTFLTLLGDHQGQW

SEQ ID NO: 775191 - protein, 519 aa, Homo sapiens
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 775192 - protein, 153 aa, Homo sapiens
MAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 775193 - protein, 196 aa, Homo sapiens
YASPSPSPTLAEILISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLAEIYDRAKNHTLMLTW

SEQ ID NO: 775194 - protein, 557 aa, Homo sapiens
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRPCQDPGHRTDPWYPEEEFLLTNPDPPRAPASWSFPFQEKRLHFPALPCP

SEQ ID NO: 775195 - protein, 519 aa, Homo sapiens; identical to SEQ ID NO: 775191

SEQ ID NO: 775196 - protein, 363 aa, Homo sapiens
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANSFSSGIQPLLCSLIGLENPT

SEQ ID NO: 775197 - protein, 70 aa, Homo sapiens
KQRGGFAVGSFLGGPLKLQHDHLDSTHETTKYLSEAWPKDGGNGTSPDFSHSKEWFHDRDLGPNTTIKLS

SEQ ID NO: 775198 - protein, 131 aa, Homo sapiens
SSDPCQYYIACRIRLVPLPPGASHSRRKGSTSQPFLAPDIWTLPLGRPLCSHSPSHQHPSVLLRQTTHWVPHLLSHMPNTTTASLPPHLHPNRHINAPHSQTPLTPPPLYRDQEQKLFVNNEPYFLLLPIP

SEQ ID NO: 775199 - protein, 302 aa, Homo sapiens
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAQWHAREVAIGQYLHSDVGPHGRALVLEGWPFHTQRQCPTGEEMMSCCQVGSNTSMASGEVNQGRYTRWIEPEGTWVDMMRCPHLARHQDETQWTGWRDGEGLRSESSRYSAHPPTHVPDTGAGKVRFLRMEHTRSSGKFLPLVTFLTLLGDHQGQW

SEQ ID NO: 775200 - protein, 519 aa, Homo sapiens; identical to SEQ ID NO: 775191

SEQ ID NO: 775201 - protein, 473 aa, Homo sapiens
MEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 775202 - protein, 468 aa, Homo sapiens
DSTEEATEVGTPLVHAGGQASGTGGIPGSAGLEPTSSPPLPVLSSCPPPLGSTEEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 775203 - protein, 156 aa, Homo sapiens
PSNFPRTSRESTTRIKEILGSPSVAQARVQWHNLSSLQPSPPRLKQSSHLSLPSSWTMGMCQCVRNWWVLGLTDFKNEAADPRGCLVVISACCCKQDPNEQWACSHWSLFQNDTICLCDSSIWRDMKRKSHSCFSATAWLQEETKQVWKLPSRQKN

SEQ ID NO: 775204 - protein, 54 aa, Homo sapiens
GDSSRIHTLGSSSDRILMCGINEEESLPAVEPSHFCQSNCLLKGTSLSPSVSPF

SEQ ID NO: 775205 - protein, 110 aa, Homo sapiens
RWSFTLVAQAGVPWHNLSSPQSPSLEFKRFSCLSLLSSWDYRHAPPHPDNFVFLVEMGFLHVGQVGLELLISGDPSASASQSAGITGMSHCAWPGLFSLLQTACLSLALF

SEQ ID NO: 775206 - protein, 110 aa, Homo sapiens; identical to SEQ ID NO: 775205

SEQ ID NO: 775207 - protein, 42 aa, Homo sapiens
SPQCSRAAVEPMMKTTCFWAALLLHNAAKGRAKKKERKKKKK

SEQ ID NO: 775208 - protein, 69 aa, Homo sapiens
ARGQKCPGVQTPADTDQAQEDEVSLLGTENSQGAAGSQLKSSQRRAIPPVGRDSRLEGQQPGTWRRTWI

SEQ ID NO: 775209 - protein, 96 aa, Homo sapiens
SLASSSDGDGREENSGYRVLPVCQPLAQSGPGSEAVLAAACCQEIRDSGGRHFTELQNQAPSLGRSRRRTPGVLGGAGSCLLYPDPTGQLPGKLGN

SEQ ID NO: 775210 - protein, 108 aa, Homo sapiens [sequence omitted]

SEQ ID NO: 775211 - protein, 74 aa, Homo sapiens
FGNEEQPVLKASLPSKDTPKGAGRVAPPASSSVTAPRRSLLPAPKSTSTPAVLEAGTSKIKTLEEGNKCQSSIL

SEQ ID NO: 775212 - protein, 93 aa, Homo sapiens
LGSRGGGGDASWSLGSPRSVQLDQCLSANTTSRPHQEKRPGCHREQGWEHLRAAGRPAPRPGILGPLAFIRRGVDAWLWDAQVAVGQQQRKRG

SEQ ID NO: 775213 - protein, 128 aa, Homo sapiens [sequence omitted]

SEQ ID NO: 775214 - protein, 1227 aa, Homo sapiens
APPDRLPLVRLLQRRSRFGNFAALMDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTVEMGAEDTVFLEELQSRVGGPSATEVTGGTEVTPPFRSRSHPCPFLVITPLPLPCDHTPAPSLCSHPCPFLVITPLPLPCDHTPAPSLCSHPCPFLVITPLPLPCERPQRGNAPGHAHSPYPNFRVLVPHTVIRFLSCDLQSWGTLEAEQGIPSKDPLDPSMALPEMPCCPRSPGFPWCGRAGPRSQEGAALTFPSVQCVCLAFYSGGGGGRSVPSILALGRTLGTLRCRVSEPPLQLHRAPAHLCPLSVPCQPCPCRSPSPAGLRAPQMLGAALDFGDGCQPQRAKGGFHGPKAWENAQTSFSEDSTSKTSHRWDWIPLQYRHLATRRFIPKRKGADRREILMDKIPFPFSRLHEHLEYQALTQRTDVDDSKTSVKASGPSLRWEGVQRVMGVKLCTAFPPSLFLLVCDTCAHTHTHKHMCISHTCTHTNTCAYHTRAHTQTRAYHTHAHTQTRAYHTHAHKRAYHTHAHTPKHVHITHTHTHKHVHITHKHTLHTYLTHTCTCYAHVHTHVVVCFPATHTLGLHWRLFHPANVNVSRLVGALCYPVGRSHQEQSLPNVHLREEGCRGVFPAPARWKGSPETGTQYLSMRSLTSRGVGKLDRDSVTHSVLLPANPVCPYRSTRRAVGGPPGGSASASPSHLLP

SEQ ID NO: 775215 - protein, 1149 aa, Homo sapiens
RGGLILPTVRASWRDPTEDFTSSPLVDTYPGGHRAALFYTVHHAVDRSDRQEHLQAGDQEGPSVPGHRPATVPQAAPAQVLPRQRRGPPLSSVGSRLPTNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTVEMGAEDTVFLEELQSRVGGPSATEVTGGTEVTPPFRSRSHPCPFLVITPLPLPCDHTPAPSLCSHPCPFLVITPLPLPCDHTPAPSLCSHPCPFLVITPLPLPCERPQRGNAPGHAHSPYPKFRVLVPHTVIRFLSCDLQSWGTLEAEQGIPSKDPLDPSMALPEMPCCPRSPGFPWCGRAGPRSQEGAALTFPSVQCVCLAFYSGGGGGRSVPSILALGRTLGTLRCRVSEPPLQLHRAPAHLCPLSVPCQPCPCRSPSPAGLRAPQMLGAALDFGDGCQPQRANGGLSGPKAWENAQTSFSEDSTSKTSHRWDWIPLQYRHLATRRFIPKRKGADRREILMDKIPFPFSRLHEHLEYQALTQRTDVDDSKTSVKASGPSLRWEGVQRVMGVKLCTAFPPSLFLLVCDTCAHTHTHKHMCIITHMHTHKHMCISHTRTHPNTCISHTCTHTNTCISHTCTQTCISHTRTHTQTRAYHTHAHTQTRAYHTQTHVHTYLTHTCTCYAHVHTHVVVCFPATHTLGLHWRLFHPANVNVSRLVGALCYPVGRSHQEQSLPNVHLREEGCRGVFPAPARWKGSPETGTQYLSMRSLTSRGVGKLDRDSVTHSVLLPANPVCPYRSTRRAVGGPPGGSASASPSHLLP

SEQ ID NO: 775216 - protein, 72 aa, Homo sapiens
AAGRITLLALCWYPFETGLRREALEVPAVVNVGSAHSGRLLSRGGAGGWGKHVASPEAQNAAELSGRVINAA

SEQ ID NO: 775217 - protein, 93 aa, Homo sapiens
MKQSKREHGEEKTEPRAGRGTLQSEFHSAPKAPLGPPGNRGCPLVVVAQENPTKAGAPPPGRASLQRIIIPGRQAGATPARPATQSQLGPFDP

SEQ ID NO: 775218 - protein, 66 aa, Homo sapiens
TAHFLPPTIPPVSYLTRLRESHQTTREGSTTREKKRLGVITMSPTEFSSILLRTAPSDYLEDFASQ

SEQ ID NO: 775219 - protein, 78 aa, Homo sapiens
METKEPIVYTGSVERAPGECSGMTLLGSCPTEANTARTVATAPKSAWREESRHAHLILMNQLAWVMPLREKTFESTEL

SEQ ID NO: 775220 - protein, 219 aa, Homo sapiens [sequence omitted]

SEQ ID NO: 775221 - protein, 87 aa, Homo sapiens
RCYHEDRLLHAHGPPAATERAKAGPPFGPASPPACPAESGHLIPGDHTSEKRAGAGRSGMRVPSDRGFQEFNSSGSPVPPKNPGHAG

SEQ ID NO: 775222 - protein, 32 aa, Homo sapiens
MSASIASCFFMAASTAGSSYLGDQTLVLIQPA

SEQ ID NO: 775223 - protein, 1890 aa, Homo sapiens
RVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYPNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 775224 - protein, 1832 aa, Homo sapiens
RVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRLCTPEFINPGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYPNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 775225 - protein, 174 aa, Homo sapiens
MKTGTRSIKDQERKRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 775226 - protein, 999 aa, Homo sapiens
RVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQGDACSPHIAGYVMVKLIVNSTRRGLAVMGPDREPGVLEVARCM

SEQ ID NO: 775227 - protein, 254 aa, Homo sapiens
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 775228 - protein, 254 aa, Homo sapiens; identical to SEQ ID NO: 775227

SEQ ID NO: 775229 - protein, 254 aa, Homo sapiens; identical to SEQ ID NO: 775227

SEQ ID NO: 775230 - protein, 254 aa, Homo sapiens; identical to SEQ ID NO: 775227

SEQ ID NO: 775231 - protein, 254 aa, Homo sapiens; identical to SEQ ID NO: 775227

SEQ ID NO: 775232 - protein, 254 aa, Homo sapiens; identical to SEQ ID NO: 775227

SEQ ID NO: 775233 - protein, 228 aa, Homo sapiens
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPS

SEQ ID NO: 775234 - protein, 118 aa, Homo sapiens
MKPRWGSAPEVSSFLPLIAFPTSLSFPYSHQSAVWGSCPCPLLTFPFVSFPSSTRSIFLILLGEMVCWFTCISHSKTMAKILCNYLLSKDICSCSLSFYSSDVNHFYFLTLKENAFII

SEQ ID NO: 775235 - protein, 97 aa, Homo sapiens
SSTRAEPPRLGSETSWPQHSIFNQGRATTTGIGNITATAQHLQQGPSQCLEGEERNAVCVLVVVLVRGQNSRKSIYGSCRSDPSHPDSPGWTGGDPA

SEQ ID NO: 775236 - protein, 76 aa, Homo sapiens
NGFGNDGSNFGGGGSYKDFGNYNNQSSNFGPMKGGNFGGRSSGPHGGGGQYFAKPRNQGGYGGSSSSSSYGSGRRF

SEQ ID NO: 775237 - protein, 1163 aa, Homo sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 775238 - protein, 103 aa, Homo sapiens
MNREDRNVLRMKERERRNQEIQQGEDAFPPSSPLFAEPYKVTSKEDKLSSRIQSMLGNYDEMKDFEEDEEGWYLSECKVILEYKEFLQVELPRSLSLTCVPEL

SEQ ID NO: 775239 - protein, 1163 aa, Homo sapiens; identical to SEQ ID NO: 775237

SEQ ID NO: 775240 - protein, 353 aa, Homo sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKVSK

SEQ ID NO: 775241 - protein, 1109 aa, Homo sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSLNPRQQTNGNLIIGCNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 775242 - protein, 1134 aa, Homo sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 775243 - protein, 841 aa, Homo sapiens
MTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 775244 - protein, 106 aa, Homo sapiens
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTM

SEQ ID NO: 775245 - protein, 281 aa, Homo sapiens
LKSRRRQAGPQMENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 775246 - protein, 209 aa, Homo sapiens
LKSRRRQAGPQMENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVREADAGSREGPHQEVPRSKICQQPQAASFRICLHSSAAPRDRGLCLHRE

SEQ ID NO: 775247 - protein, 71 aa, Homo sapiens
MEQATLQGSEHLSGVSEQKQGTCLPVMLGNRVWDWTGGWGPGYRPSEDLSSEIDEFRDTDTEGASEIMEFK

SEQ ID NO: 775248 - protein, 123 aa, Homo sapiens
MEPAEQPSELVSAEGRNRKAVLCQRCGSRVLQPGTALFSRRQLFLPSMRKKPALSDGSNPDGDLLQEHWLVEDMFIFENVGFTKDVGNIKFLVCADCEIGPIGWHCLDDKNSFYVALERVSHE

SEQ ID NO: 775249 - protein, 123 aa, Homo sapiens; identical to SEQ ID NO: 775248

SEQ ID NO: 775250 - protein, 68 aa, Homo sapiens
LSLTILAYLTILPSLANKLTELSELIISCTIIYDSTVCKTSFGLCTIHIRAIKQLAKNPVKLPPRHHL

SEQ ID NO: 775251 - protein, 68 aa, Homo sapiens
VRGRADRGGCACEDPEVDWVVSTGTHPLSERWQLKPEEHLPRAENPGRKFCLFNTFQYGRFPYRYLSI

SEQ ID NO: 775252 - protein, 68 aa, Homo sapiens; identical to SEQ ID NO: 775251

SEQ ID NO: 775253 - protein, 100 aa, Homo sapiens
RQEDWLATRFLFSRPRQLLVPGNLSHIKTSLSKNGQASAPAMQMRPNPARAAGRARPPDRERPFSAPKAPARPFIWKPGGSRQIAAGRGGGQNALPTSEG

SEQ ID NO: 775254 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 775255 - protein, 185 aa, Homo sapiens; identical to SEQ ID NO: 775254

SEQ ID NO: 775256 - protein, 113 aa, Homo sapiens [sequence omitted]

SEQ ID NO: 775257 - protein, 138 aa, Homo sapiens
MSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 775258 - protein, 185 aa, Homo sapiens; identical to SEQ ID NO: 775254

SEQ ID NO: 775259 - protein, 185 aa, Homo sapiens; identical to SEQ ID NO: 775254

SEQ ID NO: 775260 - protein, 185 aa, Homo sapiens; identical to SEQ ID NO: 775254

SEQ ID NO: 775261 - protein, 138 aa, Homo sapiens; identical to SEQ ID NO: 775257

SEQ ID NO: 775262 - protein, 185 aa, Homo sapiens; identical to SEQ ID NO: 775254

SEQ ID NO: 775263 - protein, 112 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRF

SEQ ID NO: 775264 - protein, 1003 aa, Homo sapiens
SSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMVRIAAEERERTREQEGVMWGDQFLQ

SEQ ID NO: 775265 - protein, 1026 aa, Homo sapiens
SSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKCQPQPQSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMALPVDRKRSQEPSRPSPTPQGPPFGGSRTPSTSDMAEEGRVASGGPPGLETSESLSDSLYDSLSSCGSQG

SEQ ID NO: 775266 - protein, 1048 aa, Homo sapiens
SSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMALPVDRKRSQEPSRPSPTPQGPPFGGSRTPSTSDMAEEGRVASGGPPGLETSESLSDSLYDSLSSCGSQG

SEQ ID NO: 775267 - protein, 1003 aa, Homo sapiens; identical to SEQ ID NO: 775264

SEQ ID NO: 775268 - protein, 92 aa, Homo sapiens
KEGAGGGSPLRREVKMEARKLEAESLNISKLMAKAEDLRRALEEEKAYLSSRARPRPGGPAPGPNTGLGQVQGQLAGMYQGADTFMQQLLNR

SEQ ID NO: 775269 - protein, 1048 aa, Homo sapiens; identical to SEQ ID NO: 775266

SEQ ID NO: 775270 - protein, 80 aa, Homo sapiens
PRIPRVFLPNYPILHLRSLPEILLIEEKSPEPRLFLLIRESKPRPLKKLNQLGEGKGCWQHLDYSPNQTPHNGAAAADNP

SEQ ID NO: 775271 - protein, 240 aa, Homo sapiens
GRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEGIGRRGSGGGRVQRKEGR

SEQ ID NO: 775272 - protein, 31 aa, Homo sapiens
VGRGRQSSYQGEAEMAQQETCPQNATNAPGQ

SEQ ID NO: 775273 - protein, 240 aa, Homo sapiens
RALCTPNEHFRFPQLQRPAGNFAGAAEFRSAAKAPTPREGGKASAGRWRQAAGQAWGVTPAPHSALGSGRLSAPGRSFGGRDSGPALPLSLPLGGRWQHRTASRPKDSGAGYRGQRNVSGTRVSSPAKQAPADGRYVLNVAVRWPVRPECWFTFPEVRVRVLTKNTVPFLCSLFAWAIHVHIQLHSESCFCCCCCCCCCLRRSLALLPRLEAGRYNGSLQAPPPGFTPFSCLSLPATQEA

SEQ ID NO: 775274 - protein, 47 aa, Homo sapiens
MAALSHHAVCPGSGLGDSSEGLQFLAATSTLTLGLCHRATPGVEGEL

SEQ ID NO: 775275 - protein, 346 aa, Homo sapiens
AQPGREEGGGTGGGTGGGRAGRRQPRAAPGTSTDSLFQPRCPPLSLHSAGAPSPVRQGTGPGGTMVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATRTSSPPPGLHWAVGTEPGWWGQGAEEEEKGSQEGDQEVQGHGVPVETPEAQEEPCSGVLEGAVVAGEGQGELEGSLLLAQEAQGPVGPPESPCACSSVHPSV

SEQ ID NO: 775276 - protein, 282 aa, Homo sapiens
MVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATRTSSPPPGLHWAVGTEPGWWGQGAEEEEKGSQEGDQEVQGHGVPVETPEAQEEPCSGVLEGAVVAGEGQGELEGSLLLAQEAQGPVGPPESPCACSSVHPSV

SEQ ID NO: 775277 - protein, 346 aa, Homo sapiens; identical to SEQ ID NO: 775275

SEQ ID NO: 775278 - protein, 346 aa, Homo sapiens; identical to SEQ ID NO: 775275

SEQ ID NO: 775279 - protein, 346 aa, Homo sapiens; identical to SEQ ID NO: 775275

SEQ ID NO: 775280 - protein, 346 aa, Homo sapiens; identical to SEQ ID NO: 775275

SEQ ID NO: 775281 - protein, 35 aa, Homo sapiens
EVGPLHFWSPLDTQEEVPSHPRTCCAGVVFLPESP

SEQ ID NO: 775282 - protein, 118 aa, Homo sapiens
SSSNSPASASQVAGITDSIGRDIPKMLELFKNGHEIKVDEERENFLQTKIATLDMSSDQIAANLQAVINEVCRHRPLNLGPFVVRAFLRSSTSEGLLLKIDPLLPKEVKNEESEKEDA

SEQ ID NO: 775283 - protein, 254 aa, Homo sapiens
MAAAVRCMGRALIHHQRHSLSKMVYQTSLCSCSVNIRVPNRHFAAATKSAKKTKKGAKEKTPDEKKDEIEKIKAYPYMEGEPEDDVYLKRLYPRQIYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIMPELNRLRKKLNKKYPKLSRNSIGRDIPKMLELFKNGHEIKVDEESEKEDA

SEQ ID NO: 775284 - protein, 318 aa, Homo sapiens [sequence omitted]

SEQ ID NO: 775285 - protein, 318 aa, Homo sapiens [sequence omitted]

SEQ ID NO: 775286 - protein, 318 aa, Homo sapiens [sequence omitted]

SEQ ID NO: 775287 - protein, 318 aa, Homo sapiens [sequence omitted]

SEQ ID NO: 775288 - protein, 55 aa, Homo sapiens
MQALWLPPPWGPMSPVACVVMACAGPHVRCVSAHPVNVTGGALTQDVHMSCTARM

SEQ ID NO: 775289 - protein, 177 aa, Homo sapiens
MRSVLRQRILKPKDVAIYSGEVNQVIADLIKRIYLLRSQAEDGETVTNVNDLFFKYSMEGVATILYESRLGCLENSIPQLTVEYIEALELMFSMFKTSMYAGAIPRWLRPFIPKPWREFCRSWDGLFKFSQIHVDNKLRDIQYQMDRGRRGERGTSHNLFLSQALTLQEIYANVTEM

SEQ ID NO: 775290 - protein, 177 aa, Homo sapiens; identical to SEQ ID NO: 775289

SEQ ID NO: 775291 - protein, 115 aa, Homo sapiens
MFFDTTPKLNKWKIHVSCKVESETLSMSISFIVTLKSISPSCTLKGSFTHAWFYNMMPWPLRKCWFTELCTSFKYGYVSLHNIKISHFIKLQLILSEMSLKILSIEELSSSYLWM

SEQ ID NO: 775292 - protein, 68 aa, Homo sapiens
MALLGLLKVGVQKLRVLKLQGACYAHGHQSYIGTFTYCSMQPPILALPRCPQAHPKAPCHTASPSTCQ

SEQ ID NO: 775293 - protein, 105 aa, Homo sapiens
CQGGGGPGLPAGLPLRELGRQWQLWLALRLQPKDVEQNRTGESLGASGSVLRSSPGEVVKGGRALGRENDPARGPGGEVTPACRHRVLWLGLSHPVLRVDNVDRA

SEQ ID NO: 775294 - protein, 385 aa, Homo sapiens
KIHLFIQQTVAEGLLCAVPGLGMKAPDVRSEAAAQEDTPDGALGPGRWWRHHIRNNFVRKVNLTVRTEFSLKTSFTSLFPELNSTFCNKQNVHMLNKGTQAGNLEIVNGAKNTLEPTPSSSEAKLEEDSDVTSWSEEKHEEKMLFTSYPEDRKLKKNKKNAHEGVSWFVPLENVELDKKKENMLKTHDPGISRLEPVTKTKPWREPLWERNWQGQHLDSRGYLAGPGREDGRNPLKLFVRATLQESLQFHRPDFISHIWERIKRLKLIVQERKLQSMLKSERDALFDIDRERQGHQNRMRPLPKRVFLAVQKNKPISKKEMIQRSKRTHAGGTVAHKASRCLVGERKASRERRETPRDPGDVGKQHPDHVRTPPAGGDSRPGKVF

SEQ ID NO: 775295 - protein, 108 aa, Homo sapiens
FPTSTEFFQDVKKNLSRPRGLNIRSQPDQRVALGQVHCCFLAQLASTPPTSRIKCPPQPNSLPPPRCSGSDSVAFVETWVSEGEGHEIQPDGLKILKELFSNSGTGID

SEQ ID NO: 775296 - protein, 39 aa, Homo sapiens
FALGWSWLSTHTLSPAPGMSAACPTAGHQSWMEDSCPGM

SEQ ID NO: 775297 - protein, 142 aa, Homo sapiens
MLMRRFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGVDYASYYQGLWDCHGDQPDELSFQRGDLIRILSK

SEQ ID NO: 775298 - protein, 35 aa, Homo sapiens
MTPSPAGPTLCIQSTGHPHPGLKDAGMISPAGSSP

SEQ ID NO: 775299 - protein, 146 aa, Homo sapiens
MVWLCVLHSASLAFRLLDAALFPAGGRRGGQAPRSLAAPGAFQAQPGHGAETQTSRGLRAELHKPSCYTEGKNLRKPLTFLNNLDIAESCLAHGTGRDAEGKVSSDERYRPGGKSSACSTHFADPVGIICVDALCSLRSPLEMTRN

SEQ ID NO: 775300 - protein, 161 aa, Homo sapiens
MVEADRPGKHFIGGLNRENNEKMFKAVFAKHGPISEVLLIKDRTSKSRGFAFTTFENTADAKNAAKHMIGKPLDGKAIKVEQAKKPSFQSGGRQRPPASSRSRSPSGCLRSARGSSGGTRGWHPSHEGRLGNVLKCKDGTIGLKENKFEDIEISQLYLFPL

SEQ ID NO: 775301 - protein, 114 aa, Homo sapiens
LTPRDHSPPVNYSPPTSRRLPFGEPSLPLPETILLYPQPTAPRAGPPLSLPPPPSKLWAGPGTCQANAGGGEGVGGVGSAPSQVRLSCQNAEPPPPQQGHAQSWGREEGLWCRR

SEQ ID NO: 775302 - protein, 137 aa, Homo sapiens
HEDLFRTISNGTSAVVYETLKLKLRRRLAMGKNVSKAVEHINKTIEPALISKHLNVIEQKRIDKLMIETVDPDNRSKFGVNIILGISFAVCKAGAAEKGFSLLSQNCEFAGNSEGILLVPAFTVTSNGSQSGNKLAV

SEQ ID NO: 775303 - protein, 333 aa, Homo sapiens
MEENDPKPGEAAAAVEGQRQPESSPGGGSGGGGGSSPGEADTGRRRALMLPAVLQAPGNHQHPHRITNFFIDNILRPEFGRRKDAGTCCAGAGGGRGGGAGGEGGASGAEGGGGAGGSEQLLGSGSREPRQNPPCAPGAGGPLPAAGSDSPGDGEGGSKTLSLHGGAKKGGDPGGPLDGSLKARGLGGGDLSVSSDSDSSQAGANLGAQPMLWPAWVYCTRYSDRPSSGPRSRKPKKKNPNKEDKRPRTAFTAEQLQRLKAEFQTNRYLTEQRRQSLAQELSLNESQIKIWFQNKRAKIKKATGNKNTLAVHLMAQGLYNHSTTAKEGKSDSE

SEQ ID NO: 775304 - protein, 171 aa, Homo sapiens
NLGQDRHTCFPAQTSHFPRPPWLSMPPFWAYKNPRPLQADTQVAGRPNEQHIRGRRHKRWSSIGAPQQKDTLTGTRKPVGRGPAGGGGGWPGQSGESRGCRAPQLQGKTISLLAAPWAESYFHSIKLCTHSPSLWVIRFFRYNKARTQIQKALCSCHNVEGLIELVNTSRL

SEQ ID NO: 775305 - protein, 740 aa, Homo sapiens
MLFLFVRGPLLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIENFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEVVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQVRNASQSSPCTPLAERQPGPWPECTEFKTVLYF

SEQ ID NO: 775306 - protein, 671 aa, Homo sapiens
RLACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEVVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 775307 - protein, 362 aa, Homo sapiens
MTADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 775308 - protein, 101 aa, Homo sapiens
SYSALEAVPAQKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 775309 - protein, 996 aa, Homo sapiens
MRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIENFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEVVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 775310 - protein, 448 aa, Homo sapiens
MTADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVSTALRPVPLQGAAAKCQRPETSHGEPSTCCRRPGVTWLLQISLPWDPQVIQSWVHSPHLQTPGSPSQRLLEPCVDAPYLHRQLLRVLRQYSINLSEEEFFHILEYYDKTLSSKISYNDFLRAFLQ

SEQ ID NO: 775311 - protein, 211 aa, Homo sapiens
MRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVGEWVSLCFYPAEVQLFSYTNIL

SEQ ID NO: 775312 - protein, 448 aa, Homo sapiens; identical to SEQ ID NO: 775310

SEQ ID NO: 775313 - protein, 137 aa, Homo sapiens
HTELKEKCAASNQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775314 - protein, 143 aa, Homo sapiens
MVEILQHVIDYIRDLQLDLNSESEVGTPGGRGLPVRAPGVYRVSTPYIYSRNRRRHTSIFHPHEPTTSPTKCHATSLTRRHTKILGLARVSRQEGLFLVTAAAAVATQGLVVVKNPQDQTHAVLRAWPDSRAGAGETARDDAD

SEQ ID NO: 775315 - protein, 311 aa, Homo sapiens
AAEGQVVSARAPGAATAAALPRALAIASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEATRDYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775316 - protein, 292 aa, Homo sapiens
AAEGQVVSARAPGAATAAALPRALAIASHGGKYSREKNQPKPSPKRESGEEFRMEKLNQLWEKAQRLHLPPVRLAELHADLKIQEKEARLIRNLNVILAKYGLDGKKDARQVTSNSLSGTQEDGLDDPRLEKLWHKAKTSGKFSGEELDKLWREFLHHKEKVHEYNVLLETLSRTEATRDYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775317 - protein, 311 aa, Homo sapiens; identical to SEQ ID NO: 775315

SEQ ID NO: 775318 - protein, 100 aa, Homo sapiens
TKAAESAELRTRAWARTCDRRKHPVSDQGLGTREEASAGPVRQDLQSSAQRTLKALGSPARQGRGQREGPGLLAVAFPWTARRQGGWGWHGCRGRKDCFW

SEQ ID NO: 775319 - protein, 216 aa, Homo sapiens
AAEGQVVSARAPGAATAAALPRALAIASHGGKYSREKNQPKPSPKRESGEEFRMEKLNQLWEKAQRLHLPPVRLAELHADLKIQERDELAWKKLKLDGLDEDGEKEARLIRNLNVILAKYGLGSSRPAPWVTEGVVGPEGWIDCAGVTGACIQAGEATFQRGPWQPRCRRERRARYISGDDRTNHKELSPRTQPTLGEGGTLQHGTRSRIQDDGIK

SEQ ID NO: 775320 - protein, 137 aa, Homo sapiens; identical to SEQ ID NO: 775313

SEQ ID NO: 775321 - protein, 215 aa, Homo sapiens
AAEGQVVSARAPGAATAAALPRALAIASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVL

SEQ ID NO: 775322 - protein, 100 aa, Homo sapiens
AAEGQVVSARAPGAATAAALPRALAIASHGGKYSREKNQPKPSPKRDSGEELDKLWREFLHHKEKVHEYNVLLETLSRTEEIHENVISPSDLSDIKGSVL

SEQ ID NO: 775323 - protein, 176 aa, Homo sapiens
AAEGQVVSARAPGAATAAALPRALAIASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDNWRLRTRS

SEQ ID NO: 775324 - protein, 210 aa, Homo sapiens
AAEGQVVSARAPGAATAAALPRALAIASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEATRATALRLSSRSPG

SEQ ID NO: 775325 - protein, 311 aa, Homo sapiens; identical to SEQ ID NO: 775315

SEQ ID NO: 775326 - protein, 284 aa, Homo sapiens
LGPQPQAAVAWLPTSFLPSQEHCCSTEWRAPQPAALRGSMGNGDMKEESAAQLGCCHRPMALGGTGGSLSPSLDFQLFRGDQVFSACRPLPGMVDARGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPAHLFTYGALASDQCPHLLMLPQDPSYPTMAMPSLLMMV

SEQ ID NO: 775327 - protein, 225 aa, Homo sapiens
MALGGTGGSLSPSLDFQLFRGDQVFSACRPLPGMVDARGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPAHLFTYGALASDQCPHLLMLPQDPSYPTMAMPSLLMMV

SEQ ID NO: 775328 - protein, 174 aa, Homo sapiens
MEAKGVRVTPSGWGHLIDLVHVCLHEVLGNGDMKEESAAQLGCCHRPMALGGTGGSLSPSLDFQLFRGDQSTSHQGCRPAPPMTRNSQSSTHRTRTSWENSQKELARGPPAQPSPLITALPHHRCRTERAPAPWLSAPVPLSTPSPRSSHFSSTPSTLDTHFSCLQPTCSPMGP

SEQ ID NO: 775329 - protein, 257 aa, Homo sapiens
MPGGGTAGRWKPKGNGDMKEESAAQLGCCHRPMALGGTGGSLSPSLDFQLFRGDQVFSACRPLPGMVDARGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPAHLFTYGALASDQCPHLLMLPQDPSYPTMAMPSLLMMV

SEQ ID NO: 775330 - protein, 257 aa, Homo sapiens
MPGEGRAGRWKPKGNGDMKEESAAQLGCCHRPMALGGTGGSLSPSLDFQLFRGDQVFSACRPLPGMVDARGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPAHLFTYGALASDQCPHLLMLPQDPSYPTMAMPSLLMMV

SEQ ID NO: 775331 - protein, 234 aa, Homo sapiens
LGPQPQAAVAWLPTSFLPSQEHCCSTEWRAPQPAALRGSMGNGDMKEESAAQLGCCHRPMALGGTGGSLSPSLDFQLFRGDQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPAHLFTYGALASDQCPHLLMLPQDPSYPTMAMPSLLMMV

SEQ ID NO: 775332 - protein, 218 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSMGRSQKRGTS

SEQ ID NO: 775333 - protein, 190 aa, Homo sapiens
MEESPLSRAPSRGGVNFLNVARTYIPNTKVECHYTLPPGTMPSASDWIGIFKVEAACVRDYHTFVWSSVPESTTDGKQENHHLNLDLKEAKSWQEEQSAQAQRLKDKVAQMKDTLGQAQQRVAELEPLKEQLRGAQELAASSQQKATLLGRSGQCSSSQDRTIAELHRSRLEVAEVNGRLAELRLHLKEE

SEQ ID NO: 775334 - protein, 30 aa, Homo sapiens
CQDCHLPPPAEPWSKLPNADSGKKRNQAYL

SEQ ID NO: 775335 - protein, 415 aa, Homo sapiens
MQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 775336 - protein, 415 aa, Homo sapiens; identical to SEQ ID NO: 775335

SEQ ID NO: 775337 - protein, 66 aa, Homo sapiens
GNIIRADVLEGFDFEVLNEGFLVHKGFKEALKFHPQKEAENQHNKILYRQFKQELKAKYPNSPRRC

SEQ ID NO: 775338 - protein, 415 aa, Homo sapiens; identical to SEQ ID NO: 775335

SEQ ID NO: 775339 - protein, 446 aa, Homo sapiens
VLKLRHCLGYGGSTVARCGRMLMHCRSHGRAMQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 775340 - protein, 37 aa, Homo sapiens
METRHLFTSHYLALHISSIWLFLSCIPYNKPLIVSKI

SEQ ID NO: 775341 - protein, 117 aa, Homo sapiens
KSSWGLRRSFHLDQCTEFPLHLLGYTLKKIQSLFTFTSFFNVKATGGFVQRNSDPETQHGSRQSRTLLSSGGWGKGRLHKVHTKNHGPTVTDAMLHRTAERLRSCLQNHMATSSTEL

SEQ ID NO: 775342 - protein, 144 aa, Homo sapiens
MSSSFLPEPLPAKSLQHGVPLSLDSSLSSLLEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 775343 - protein, 292 aa, Homo sapiens
GSGTGFELGLSSNCEGGYSTLHPTLRAGNCCGSAIWGNLFSSFSEPAQAHTSQAHTPGGWTCSRIASVRERQSCLEPAGLVEALVDSGRPIIDEWPGEPVQPWLSGSKPQHVCLWLHPASFSNCPSLLPISEDQTPLIAGMCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 775344 - protein, 439 aa, Homo sapiens
MAAARCWRPLLRGPRLSLHTAANAAATATETTSQDVAATPVARYPPIVASMTADSKAARLRRIERWQATVHAAESVDEKLRILTKMQFMKYMVYPQTFALNADRWYQYFTKTVFLSGLPPPPAEPEPEPEPEPEPALDLAALRAVACDCLLQEHFYLRRRRRVHRYEESEVISLPFLDQLVSTLVGLLSPHNPALAAAALDYRCPVHFYWVRGEEIIPRGHRRGRIDDLRYQIDDKPNNQIRISKQLAEFVPLDYSVPIEIPTIKCKPDKLPLFKRQYENHIFVGSKTADPCCYGHTQFHLLPDKLRRERLLRQNCADQIEVVFRANAIASLFAWTGAQAMYQGFWSEADVTRPFVSQAVITDGKYFSFFCYQLNTLALTTQADQNNPRKNICWGTQSKPLYETIEDNDVKGFNDDVLLQIVHFLLNRPKEEKSQLLEN

SEQ ID NO: 775345 - protein, 439 aa, Homo sapiens; identical to SEQ ID NO: 775344

SEQ ID NO: 775346 - protein, 439 aa, Homo sapiens; identical to SEQ ID NO: 775344

SEQ ID NO: 775347 - protein, 891 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEVPQIPHPQNPTQIPGRILRVMLKRPPYVIGSGEGGKHLGSAEGRNHGGLALGGSAGREKEGSPDGLVTLSLWGGVKMQWDCINPKYRDKKKNYKSSGTVVLAQCTVNFTSCFKPCPSPCPYHTLRFNPSLVSKTSFSASGNWKPPPTATQKTLAPPCSPQKPYPSSLLKGPPHPLALPLSLPPGGEGAHLPGLHHGWLPDQLHGKDSEGGHTGKREGLSPYERKEPRISTAPTWAAHEPSHCQLMHPHIIMWLPVASPPLILVLPTDPSSGLGNLVALMVAADLLPTPTQVAIDFTASNGDPRSSQSLHCLSPRQPNHYLQALRAVGGICQDYDRYGESGAGGNRQGGLAQRIPQLFLLPSDKRFPAFGFGARIPPNFEVGSDARERRRWGACQSGRKGRPSLLPPCPHRCPMTLLSTLTRKILNVKVKGEIFTCPASPQTHSTQEHRLHSPGPSFLSLPPIPGLSLSEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDVSPPGPFRLKDSSASHPPKSDLRLPPFDVLLRTREPSWPP

SEQ ID NO: 775348 - protein, 220 aa, Homo sapiens
MTLLSTLTRKILNVKVKGEIFTCPASPQTHSTQEHRLHSPGPSFLSLPPIPGLSLSEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDVSPPGPFRLKDSSASHPPKSDLRLPPFDVLLRTREPSWPP

SEQ ID NO: 775349 - protein, 644 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVKTQREGTQARGRGWVHSERKEPRISTAPTWAAHEPSHCQLMHPHIIMWLPVASPPLILVLPTDPSSGLGNLVALMVQHDLLPTPTQVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 775350 - protein, 644 aa, Homo sapiens; identical to SEQ ID NO: 775349

SEQ ID NO: 775351 - protein, 984 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITVGKITCTHPWSRYSMPLHGHLWCHHAQDHPHLRERGWGGPCGKVRGVLPLVSPLQIVAEEVSGTNDYVQLTFRAYKLDNKVGTPESRPPTPLSLLGLPLKTDPRSPGLLSSQWEPIPHPPCSSHQPQGPFLLYLQDLFSKSDPFMEIYKTNEDQSDQLVWRTEVGAWGYGDEGRESKVRRHRQELTSHLGLSKVVKNNLNPSWEPFRLSLHSLCSCDVHRPLKFLVYDYDSSGKHDFIGEFTSTFQEMQEGTANPGQEVPQIPHPQNPTQIPGRILRVMLKRPPYVIGSGEGGKHLGSAEGRNHGGLALGGSAGREKEGSPDGLVTLSLWGGVKMQWDCINPKYRDKKKNYKSSGTVVLAQCTVNFTSCFKPCPSPCPYHTLRFNPSLVSKTSFSASGNWKPPPTATQKTLAPPCSPQKPYPSSLLKGPPHPLAFPSPYLQVEKVHTFLDYIMGGCQISFTVAIDFTASNGDPRSSQSLHCLSPRQPNHYLQALRAVGGICQDYDRYGESGAGGNRQGGLAQRIPQLFLLPSDKRFPAFGFGARIPPNFEVSHDFAINFDPENPECEGKRGDFHLPRLPADTLHTGAQTPLPRAQLPVPSTHPRPVFIRLRLPGPRPSICTQLSLPRDHPTLPLLNEGTRGEGSPQTWKHFLALRSVRRGPCHFCQLHNFSSLTEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 775352 - protein, 976 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKVGTPESRPPTPLSLLGLPLKTDPRSPGLLSSQWEPIPHPPCSSHQPQGPFLLYLQDLFSKSDPFMEIYKTNEDQSDQLVWRTEVGAWGYGDEGRESKVRRHRQELTSHLVPLQVVKNNLNPSWEPFRLSLHSLCSCDVHRPLKFLVYDYDSSGKHDFIGEFTSTFQEMQEGTANPGQEVPQIPHPQNPTQIPGRILRVMLKRPPEVIGSGEGGKHLGSAEGRNHGGLALGGSAGREKEGSPDGLVTLSLWGGVKMQWDCINPKYRDKKKNYKSSGTVVLAQCTVNFTSCFKPCPSPCPYHTLRFNPSLVSKTSFSASGNWKPPPTATQKTLAPPCSPQKPYPSSLLKGPPHPLALPLSLPPGGEGAHLPGLHHGWLPDQLHGKDSEGGHTGKREGLSPYERKEPRISTAPTWAAHEPSHCQLMHPHIIMWLPVASPPLILVLPTDPSSGLGNLVALMVQHDLLPTPTQVAIDFTASNGDPRSSQSLHCLSPRQPNHYLQALRAVGGICQDYDRYGESGAGGNRQGGLAQRIPQLFLLPSDKRFPAFGFGARIPPNFEVRLDARERRRWGACQSGRKGRPSLLPPCPHRCPMTLLSTLTRKILNVKVKGEIFTCPASPQTHSTQEHRLHSPGPSFLSLPPIPGLSLSEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDVSPPGPFRLKDSSASHPPKSDLRLPPFDVLLRTREPSWPP

SEQ ID NO: 775353 - protein, 751 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVKTQREGTQARGRGWVHSERKEPRISTAPTWAAHEPSHCQLMHPHIIMWLPVASPPLILVLPTDPSSGLGNLVALMVAAMTFFPPPPRWPLTSLPPMGTRGAASPCTASVPDSPTTTCRPCVQWEASARTMTVISGSQLLALGLESPPTSRCPMTLLSTLTRKILNVKVKGEIFTCPASPQTHSTQEHRLHSPGPSFLSLPPIPGLSLSGEASRAEAQHLHPTLPAKGPSNFPLLNEGTRGEGSPQTWKHFLALRSVRRGPCHFCQLHNFSSLTEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 775354 - protein, 218 aa, Homo sapiens
MASRGGGRGRGRGQLTFNVEAVGIGKGDALPPPTLQPSPLFPPLEFRPVPLPSGEEGEYVLALKQELRGAMRQLPYFIRPAVPKRDVERYSDKYQMSGPIDNAIDWNPDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 775355 - protein, 218 aa, Homo sapiens; identical to SEQ ID NO: 775354

SEQ ID NO: 775356 - protein, 218 aa, Homo sapiens; identical to SEQ ID NO: 775354

SEQ ID NO: 775357 - protein, 118 aa, Homo sapiens
MSGMGGWGLTLRGGRKPGRVCEMWSRSNVPEPLRSSSPGLRLLPLSGDTAPGRLSWDWRGEGAEPAGGRVNGEALYRRRSRDRRLDSGESGQRCPGVSSSTGSMRLSFCLSPEGGPDS

SEQ ID NO: 775358 - protein, 239 aa, Homo sapiens
SSAAADSAEAWDPVHFKLVAAWAPLWGGAAGLFTGSLNTQAPSTMASRGGGRGRGRGQLTFNVEAVGIGKGDALPPPTLQPSPLFPPLEFRPVPLPSGEEGEYVLALKQELRGAMRQLPYFIRPAVPKRDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 775359 - protein, 100 aa, Homo sapiens
AGIIGMSHRAQPGSGFNGTEQPRLICCLCSVCTVYASGKNQRAKTKSSPTKLVEALLHILLIHRLRLMETLSPGTSSVTTTGGKGTWNQMSLMSNPDFAV

SEQ ID NO: 775360 - protein, 415 aa, Homo sapiens
VGLPKGQIPPEPGTPLRIVSLLYLPSREGSGKVWEPLPQREPSYRDVMLGELREMCSSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 775361 - protein, 235 aa, Homo sapiens
DSSYRSTLRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 775362 - protein, 308 aa, Homo sapiens
VGLPKGQIPPEPGTPLRIVSLLYLPSREGSGKVWEPLPQREPSYRDVMLGELREMCSSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEPL

SEQ ID NO: 775363 - protein, 415 aa, Homo sapiens; identical to SEQ ID NO: 775360

SEQ ID NO: 775364 - protein, 100 aa, Homo sapiens
SCRIRHEILLRVEEIPESSSVMMVSFRALGAARPCFQEKPGDIASRPPAIPPSCPGAEWANLSKQLVTGCEGEGQKHLALASDCCPLLSSSHSNDENDFL

SEQ ID NO: 775365 - protein, 71 aa, Homo sapiens
LHQRRYCVRRNLPMHRRPHACSQLNTQSHRSTHTHSHTEPRQSLSHTGLLTVHIKMLMHWYGCVHTHTSQS

SEQ ID NO: 775366 - protein, 217 aa, Homo sapiens
MLPSPVIFSFVKGTENLEFSWEREDIKQAYEVEDNKEYYLLFKYLDFFEVFSKLVYQFHNNTEQLEDQNSLYEGRVSVDQAEISEGTLSLLLRNVDFMDEAIYKCSAITPDGRGESTIKLIVEDSEMPQVQFDRIDDEDVATCISKDKYLTPIVTWLDRTERDLSNHSIVEILEEQMNGFYRVFSILKYPVKLNEKYLCHITETDVNNQLFRIIHKY

SEQ ID NO: 775367 - protein, 70 aa, Homo sapiens
RTVSGSVYFASTSVPPRPGAAPGHILFLSRLQPLRAEVSRSHGLVFLCEVYQACAQGNRDLPEVDCTCKY

SEQ ID NO: 775368 - protein, 68 aa, Homo sapiens
LLYASTFCSGSTFCSGSTFCSGSTFCSGSTFCSGSTFCSGSTFCSGSTYLSDVDLLHWATSIFFIVRI

SEQ ID NO: 775369 - protein, 76 aa, Homo sapiens
EEDDVPPEEKRLRLLLEGGSAQPEDCEDGEDALRPGKEDTGTQTGGDGRGGASNCCPENTCKRIIQAACSLCMHTL

SEQ ID NO: 775370 - protein, 163 aa, Homo sapiens
MALLLSDWCPDGDADTHTGTDPGRTTHRLCARERGVRGTQPCPRIYLRLPAQNCEETRFCCASPGSVVLGHGAPRTASPPSALSHPSPLEGLSFSPFPPSVLSHPSPPEGLSFSLFHCLCSGKLSESPGCFWNSLGWSFSVLTEPGVWKVGEAIWVAENLAQP

SEQ ID NO: 775371 - protein, 179 aa, Homo sapiens [sequence omitted]

SEQ ID NO: 775372 - protein, 33 aa, Homo sapiens
MRSSWEVLATCAPTPVPPPAVPPGATYGGMAPG

SEQ ID NO: 775373 - protein, 130 aa, Homo sapiens; identical to SEQ ID NO: 742470

SEQ ID NO: 775374 - protein, 520 aa, Homo sapiens
MGLSNPFQGLMKLGTVERQGAMGIWKELFCELSPLEFRLYLSNEEHTCVENCSLLRCESVGPAHSDGRFELVFSGKKLALRASSQDEAEDWLDLVREALQKVRPQQEDEWVNVQYSDQPEEPPEAPQGCLSPSDLLSEPAALQGTQSDWSSAQVPELDAIKESLLYLYMDRTWMPYIFSLPLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRSREQLKLLGDYLGLCRSGALKELSKRLNHRNYLLESPHRFRVADLRQIADEVYEGFLKALIEFASQHVYHCDLCTQRSFICQICQHHDIIFPSEFDTTVRCAKCKTVFHQSCQAVVKKGCPRCAR

SEQ ID NO: 775375 - protein, 565 aa, Homo sapiens
MGLSNPFQGLMKLGTVERQGAMGIWKELFCELSPLEFRLYLSNEEHTCVENCSLLRCESVGPAHSDGRFELVFSGKKLALRASSQDEAEDWLDLVREALQKVRPQQEDEWVNVQYSDQPEEPPEAPQGCLSPSDLLSEPAALQGTQSDWSSAQVPELDAIKESLLYLYMDRTWMPYIFSLPLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRSREQLKLLGDYLGLCRSGALKELSKRLNHRNYLLESPHRFRVADLRQVRVSCLPRPELKKDFIPGEVSKEDGREGVCSLLKKTAAAAFLQLRIADEVYEGFLKALIEFASQHVYHCDLCTQRSFICQICQHHDIIFPSEFDTTVRCAKCKTVFHQSCQAVVKKGCPRCAR

SEQ ID NO: 775376 - protein, 202 aa, Homo sapiens
MESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 775377 - protein, 230 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEAEQDCNLI

SEQ ID NO: 775378 - protein, 220 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFSTKGVKEQPSSLSHGSFLAHKFFTAP

SEQ ID NO: 775379 - protein, 202 aa, Homo sapiens; identical to SEQ ID NO: 775376

SEQ ID NO: 775380 - protein, 136 aa, Homo sapiens
MRVFWVFLVYLYSLCIRDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 775381 - protein, 123 aa, Homo sapiens
MEPQEERETQVAAWLKKIFGDHPIPQYEVNPRTTEILHHLSERNRVRDRDVYLVIEDLKQKASEYESEGATFSQRHGCFSVSSVLSSTIRETGKIKATDYTFEEKIGVLFRLNAESVSCSSEN

SEQ ID NO: 775382 - protein, 278 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 775383 - protein, 123 aa, Homo sapiens
MKSSDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 775384 - protein, 278 aa, Homo sapiens; identical to SEQ ID NO: 775382

SEQ ID NO: 775385 - protein, 138 aa, Homo sapiens
MEPQEERETQVAAWLKKIFGDHPIPQYEVNPRTTEILHHLSERNRVRDRDVYLVIEDLKQKASEYESEAKYLQDLLMESVNFSPAKSKSEEIKIELEKLEDTYSVDTVRIRESLSYRHEDGENKGREDRGREKRGKGK

SEQ ID NO: 775386 - protein, 1412 aa, Homo sapiens
SRARCSREVEAPAALFSGSRGEGAMAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 775387 - protein, 1089 aa, Homo sapiens
MAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKPWYTVVNVRAYIQLRDKQLTFTHLFKHLLISNKPGTDLVNSRTFRVETVNKTSLSSWILTSSTGDREILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 775388 - protein, 1500 aa, Homo sapiens
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMVCPALFKTLLVYLNTRQCPGSCGPSDSQAEENTQLKDKYTSRNYAKGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKPWYTVVNVELYIQLRDKQLTFTHLFKHLLISNKPGTDLVNSRTFRVETVNKTSLSSWILTSAQGDREILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 775389 - protein, 958 aa, Homo sapiens
MAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKPWYTVVNVRAYIQLRDKQLTFTHLFKHLLISNKPGTDLVNSRTFRVETVNKTSLSSWILTSSTGDREILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKR

SEQ ID NO: 775390 - protein, 452 aa, Homo sapiens
MAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDCKLFYQELCDLKEYCNSISFYFY

SEQ ID NO: 775391 - protein, 226 aa, Homo sapiens
MAATAVAAAVAGTESAQGPPGPAASLELWLNKATDPSMSEQDWSAIQNFCEQVNTDPNGPTHAPWLLAHKIQSPQEKEALYALTRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVAPFHNQPGLHIVQIFTKT

SEQ ID NO: 775392 - protein, 73 aa, Homo sapiens
ESARTLQQLKRQWRPRPRRRGWSDGGDRGGGGCGGNRVGPGSPGPGSVAGAVAEQSHRPKHVGTGLVSYPEFL

SEQ ID NO: 775393 - protein, 613 aa, Homo sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775394 - protein, 613 aa, Homo sapiens; identical to SEQ ID NO: 775393

SEQ ID NO: 775395 - protein, 526 aa, Homo sapiens
MCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775396 - protein, 526 aa, Homo sapiens; identical to SEQ ID NO: 775395

SEQ ID NO: 775397 - protein, 656 aa, Homo sapiens
MAATAVAAAVAGTESAQGPPGPAASLELWLNKATDPSMSEQDWSAIQNFCEQVNTDPNGPTHAPWLLAHKIQSPQEKEALYALTCPHRLEAGLALVPAQSPASDYQPGGEPGTTGFPPSPGGPVSVQVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775398 - protein, 460 aa, Homo sapiens [sequence omitted]

SEQ ID NO: 775399 - protein, 379 aa, Homo sapiens
GWSPKVYVSWPMELTNILTAGQAGPARSGGPEVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775400 - protein, 403 aa, Homo sapiens
LLLQAWLVKNSCEEKEESLLQHPRVFKNPSDRNLLDLLSHMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775401 - protein, 585 aa, Homo sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLFLSASEPGPIHFPSTMNSPNRYSLDIKYLEGQEEEGGQDPGITVVPLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775402 - protein, 301 aa, Homo sapiens
YRLACMHADCRVSTRQPLTMRYLVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775403 - protein, 149 aa, Homo sapiens
RPAPGPGYGEGCPLESVTPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 775404 - protein, 495 aa, Homo sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPRKWLWFMASTPF

SEQ ID NO: 775405 - protein, 169 aa, Homo sapiens
RPRGRGAWAGPGGDYSGVRRQQRRRTRISGSQRRSDAAGTMGCCTGRCSLICLCALQLVSALERQIFDFLGFQWAPILGNFLHIIVVILGLFGTIQYRPRYIMVYTVWTALWVTWNVFIICFYLEVGGLSKDTDLMTFNISVHRSWWREHGAWLCQEECCLPSSPMAMD

SEQ ID NO: 775406 - protein, 142 aa, Homo sapiens
RPRGRGAWAGPGGDYSGVRRQQRRRTRISGSQRRSDAAGTMGCCTGRCSLICLCALQLVSALERQIFDFLGFQWAPILGNFLHIIVVILGLFGTIQYRPRYIMVDTDLMTFNISVHRSWWREHGAWLCQEECCLPSSPMAMD

SEQ ID NO: 775407 - protein, 163 aa, Homo sapiens
RPRGRGAWAGPGGDYSGVRRQQRRRTRISGSQRRSDAAGTMGCCTGRCSLICLCALQLVSALERQIFDFLGFQWAPILGNFLHIIVVILGLFGTIQYRPRYIMVYTVWTALWVTWNVFIICFYLEVGGLSKKQEERRKKERRPGAVANACNPSTLGGRSRQIT

SEQ ID NO: 775408 - protein, 76 aa, Homo sapiens
VVPDLLHVVPVGDDAVLDGVLQGDEAQSKRGILTFYNELRVAPEEHPVLLTEAPLNPKANREKMTQIMFETFNTPA

SEQ ID NO: 775409 - protein, 74 aa, Homo sapiens
PKSPLGKELKDKPPEESSIVLFTTWQGIGSCAHLIDRHLDQVLSRIILFDKQQPYGIHENVQGTLTEIRISFQE

SEQ ID NO: 775410 - protein, 81 aa, Homo sapiens
TLPPSCLSTAVSLVQATIICHPDYHSHLLTGPPTCRLYSAHSSLSSYTHVHSFIFCLKLFNGFPWNLESDIFTSVCMAQTI

SEQ ID NO: 775411 - protein, 201 aa, Homo sapiens
TTSGAAVAAAAAAAAAASPTRIPTVTILSPGGRRGGRGSDGSGGSWTKQVTCRYFMHGVYKEGDNCCKLHDLSDSPYNVVYKSLQPGYCIYGDCCRYEHSKPLKQKEATATELTTKSSLAASSSLSWIVGPLVEMNTGEAESRNSNFVTVGAGSEGWVNAVEFVPGQPYCGRTAPSCTEAPLQGSVTKEESEKEQTAVETK

SEQ ID NO: 775412 - protein, 51 aa, Homo sapiens
MTVKLGDGGSGEDGLKKLGKRAADEESLEGEGAGGADAAEESSGTKRDEKT

SEQ ID NO: 775413 - protein, 37 aa, Homo sapiens
QESVGCNAKRTNRNHLYREIRSMPCFFLLLFLHTYTA

SEQ ID NO: 775414 - protein, 433 aa, Homo sapiens
MPCGKQGNLQVPGSKVLPGLGEGCKEMWLRKVIYGGEVWGKSPEPEFPSLVNLCQSWKINNLMSTVHSDEAGMLSYFLFEELMRCDKDSMPDGNLSEEEKLFLSYFPLHKFELEQNIKELNTLADQVDTTHELLTKTSLVASSSGAVSGVMNILGLALAPVTAGGSLMLSATGTGLGAAAAITNIVTNVLENRSNSAARDKASRLGPLTTSHEAFGGINWSEIEAAGFCVNKCVKAIQGIKDLHAYQMAKSNSGFMAMVKNFVAKRHIPFWTARGVQRAFEGTTLAMTNGAWVMGAAGAGFLLMKDMSSFLQSWKHLEDGARTETAEELRALAKKLEQELDRLTQHHRHLPQKASQTCSSSRGRAVRGSRVVKPEGSRSPLPWPVVEHQPRLGPGVALRTPKRTVSAPRMLGHQPAPPAPARKGRQAPGRHRQ

SEQ ID NO: 775415 - protein, 32 aa, Homo sapiens
MSFRAEMTQEEMSLILVHLQAWEKVVKKCGFE

SEQ ID NO: 775416 - protein, 194 aa, Homo sapiens
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASE

SEQ ID NO: 775417 - protein, 46 aa, Homo sapiens
PPGPGPWQILLINWSKLHGPRQGWPAWKEPEHVLRQPWMEQLGNQG

SEQ ID NO: 775418 - protein, 389 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 775419 - protein, 389 aa, Homo sapiens; identical to SEQ ID NO: 775418

SEQ ID NO: 775420 - protein, 230 aa, Homo sapiens
PRVADAWVDPRVGFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 775421 - protein, 389 aa, Homo sapiens; identical to SEQ ID NO: 775418

SEQ ID NO: 775422 - protein, 389 aa, Homo sapiens; identical to SEQ ID NO: 775418

SEQ ID NO: 775423 - protein, 136 aa, Homo sapiens
AGGAPAAASALGPRGSPVPGVVQSVSSSPCLPGHRNTDPGWGELEGSGPQTPDAFLVPRALSNEILGLKLPGEPPLTANTVCLTLSGLSKRQLGLCLRNPDVTASALQGLHIAVHECQHQLRDQRWNCSALEGGGR

SEQ ID NO: 775424 - protein, 133 aa, Homo sapiens
ILFLFKAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLDTDLI

SEQ ID NO: 775425 - protein, 171 aa, Homo sapiens
GGGVSELKVSLLQSPSSGLHQQRCAENEHSLLGSHHTAFQHNRVIGHFTIVDKATQKVDALVRQVIVRGGIVLDRFAVLSKVALVNLTDLLVDLSVVMVAFLPSTCHGEGHMVRMPCPNPGHLAQASVGLVGQLLGVPTTGDPFVAFALGHPDDVDHLVQPKRLVHRYLLL

SEQ ID NO: 775426 - protein, 98 aa, Homo sapiens
MRLPYGCLGLLVPLQQCAEEGVTLLAEGTDPDYQGESGMLHREASRTMSRAQEILGRALVPPCPVVKARGSTATKNTATPKNDSTVENSDPSGTKAWV

SEQ ID NO: 775427 - protein, 467 aa, Homo sapiens
IPFPAVPTPVFGRPGCSASWSKRGSGPDMLSSMAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRSSLELLLEAYFCGRVGRNNHKFISQLMCDYFFKCMTCKSGIGVFELVDDHFVELNVGVTGLPVSDSRIIAGLVLQKDFSVYRPADGDMRMVIVTETIQPLFSTSGSEFILNSEAQFQTSQFWIMEKTKAIMKHLHSQNVKLLISSVKQPDLVSYYAGVNGISVVECLSSEEVSLIRRIIGLSPFVPPQAFSQCEIPNTALVKFCKPLILRSKRYVHLGLISTCAFIPHSIVLCGPVHGLIEQHEDALHGALKMLRQLFKDLDLNYMTQTNDQ

SEQ ID NO: 775428 - protein, 115 aa, Homo sapiens
PCFRSARVFCKLVKKGKRPRYVKFYGRCRVCEGGVAGGRGAGSHRELLRGARGTASFVYEAHWRGASQPEWRPPPGGATLRASHSQVPASHTLTRSRAPQAASVELLSHPEAMRT

SEQ ID NO: 775429 - protein, 474 aa, Homo sapiens
RSLGSTIENPWWFITQLSANPDGCLPSLFKRNGPDMLSSMAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRSSLELLLEAYFCGRVGRNNHKFISQLMCDYFFKCMTCKSGIGVFELVDDHFVELNVGVTGLPVSDSRIIAGLVLQKDFSVYRPADGDMRMVIVTETIQPLFSTSGSEFILNSEAQFQTSQFWIMEKTKAIMKHLHSQNVKLLISSVKQPDLVSYYAGVNGISVVECLSSEEVSLIRRIIGLSPFVPPQAFSQCEIPNTALVKFCKPLILRSKRYVHLGLISTCAFIPHSIVLCGPVHGLIEQHEDALHGALKMLRQLFKDLDLNYMTQTNDQ

SEQ ID NO: 775430 - protein, 71 aa, Homo sapiens
QCQWLCALAVAVAVVAVAVAVVTCGSGSSSGSGSGSGISSGSGSGSSSSGSGDSGSGSSGSGNGSGISSGS

SEQ ID NO: 775431 - protein, 232 aa, Homo sapiens
ATELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKEGHQLKQLLLKALTLMLDAAESYAKDSCVCQAQHCQRLTKITLQIHFLNTGQNTMLINLGPAQADGLYSGPNLGLQASIEADAYDGPKLG

SEQ ID NO: 775432 - protein, 110 aa, Homo sapiens
MSGAALGLEIVFVFFLALFLLHRYGDFKKQHRLVIIGTLLAWYLCFLIVFILPLDVSTTIYNRCKHAAANSSPPENSNITGLYATANPVPRYFLFLKKYINIVGDTLFKN

SEQ ID NO: 775433 - protein, 123 aa, Homo sapiens
MSGAALGLEIVFVFFLALFLLHRYGDFKKQHRLVIIGTLLAWYLCFLIVFILPLDVSTTIYNRCKHAAANSSPPENSNITGLYATANPVPSQHPCFKPWSYIPDGIMPIFWRVVYWTSQFLTW

SEQ ID NO: 775434 - protein, 85 aa, Homo sapiens
WRPTGWAGRRKRAALRLTGKCQPLDCRRIFLSREPAGLLVIASAVVSERGSQNLDSCGGRRFPVPSRRCLARSDGEPKAERVRRF

SEQ ID NO: 775435 - protein, 118 aa, Homo sapiens
GSVRGAGSVISEREPRPGEVPAECSRAEEVPRPEEGKRRSLLLPGSPRDAERIAQPSAAAQREPELRPRTGVSPAELTRRAGCAFPREECAVESKLWKTSHPNSQRAARRPERRWSHR

SEQ ID NO: 775436 - protein, 71 aa, Homo sapiens
SQHKCPPHMMYACKKLLSSFDLAPHTASFGVCPLLSVTRVVATEHWLFLASLSGIKTYQSYISVFCKVTLI

SEQ ID NO: 775437 - protein, 811 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775438 - protein, 828 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775439 - protein, 123 aa, Homo sapiens
PHVYSEEHLGALACRVAVGRREEGSALCNARPQPCVGKTAGAENQNQEQGRRVADTPQTLTQQRSWNLDSDAVGRGDGGQTRREEGGQGPHEAGSPEAGLNRGGGPSRLRRARPTDVFIVQTM

SEQ ID NO: 775440 - protein, 828 aa, Homo sapiens; identical to SEQ ID NO: 775438

SEQ ID NO: 775441 - protein, 761 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQVPSTGLARG

SEQ ID NO: 775442 - protein, 788 aa, Homo sapiens
GHTTALGPSQAPLPSPEATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775443 - protein, 808 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775444 - protein, 810 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLELKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775445 - protein, 828 aa, Homo sapiens; identical to SEQ ID NO: 775438

SEQ ID NO: 775446 - protein, 801 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQDRSRLSWPGRSARSGGGRWRPNAPRGRWPRAP

SEQ ID NO: 775447 - protein, 548 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775448 - protein, 633 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEAKLPGATS

SEQ ID NO: 775449 - protein, 761 aa, Homo sapiens; identical to SEQ ID NO: 775441

SEQ ID NO: 775450 - protein, 761 aa, Homo sapiens; identical to SEQ ID NO: 775441

SEQ ID NO: 775451 - protein, 723 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQSAIRPNPPFPSRGQGRGLEGWGHPGP

SEQ ID NO: 775452 - protein, 413 aa, Homo sapiens
HASRTPWVDPRVGRSSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775453 - protein, 380 aa, Homo sapiens
MLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775454 - protein, 592 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKMSITSACMGDPATGSFDKIL

SEQ ID NO: 775455 - protein, 310 aa, Homo sapiens
FCVVVCFFFLKRHDLIYQFLGNTLWEEGRQRPPETLQPPANRGGGPVGAPRVSRRREGLRALKVPGSEPQVGAEVRPSSRKSLSDHRGLGRGRRRRRQRRRWGTQAPCGRLRAKPALQTQRKEPLVFTQRSLLHSSPRWFSSRHSSISTQRAREASSWKPPGHSHTAPPGRGTQRPLTQRHSSESSSELSSSLGGFPQQQGACVPEGIALALRCRAMGPRAARRARSALGAPAAALAAAAVVEGEGRPGQGASAHAVLSALAPAHVAPLRGTLGPALGGAWQSEPEGPGTKGGRHSQREEPGRLTQRPGR

SEQ ID NO: 775456 - protein, 807 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQSPTGAAGKLRAPGNRAGRSQAPRSHLLTVHGWPASITGVAQSPATRATPSLPCLHVPAPSRGQTLGVRTTGRASRLTVDRSRLSWPGRSARSGGGRWRPNAPRGRWPRAP

SEQ ID NO: 775457 - protein, 828 aa, Homo sapiens; identical to SEQ ID NO: 775438

SEQ ID NO: 775458 - protein, 807 aa, Homo sapiens; identical to SEQ ID NO: 775456

SEQ ID NO: 775459 - protein, 747 aa, Homo sapiens
PRVADAWVDHAVCNILAYIDVLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775460 - protein, 828 aa, Homo sapiens; identical to SEQ ID NO: 775438

SEQ ID NO: 775461 - protein, 828 aa, Homo sapiens; identical to SEQ ID NO: 775438

SEQ ID NO: 775462 - protein, 828 aa, Homo sapiens; identical to SEQ ID NO: 775438

SEQ ID NO: 775463 - protein, 778 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRKCFPWVG

SEQ ID NO: 775464 - protein, 486 aa, Homo sapiens
GQLDSTEEVDSTGQVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775465 - protein, 411 aa, Homo sapiens
MPVTSCPSGSRRSSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 775466 - protein, 636 aa, Homo sapiens
ARACGGPGAKAPEPAAAVGTMWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEATGRRRRRRHS

SEQ ID NO: 775467 - protein, 69 aa, Homo sapiens
MAICMFTEGPACISRERKPSGHWCIKIFGNVQKIPNIACPACQASLATSLLPSRTSSCHFLENPSHAVV

SEQ ID NO: 775468 - protein, 44 aa, Homo sapiens
ASKQSPLNQSWVSGRSRSSVSTQHLYQTDCVGSAFLERGTQPDD

SEQ ID NO: 775469 - protein, 739 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 775470 - protein, 683 aa, Homo sapiens
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 775471 - protein, 739 aa, Homo sapiens; identical to SEQ ID NO: 775469

SEQ ID NO: 775472 - protein, 478 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGQPGRKGSCNCHWSCPHVHFSHDILPGSNGMSGV

SEQ ID NO: 775473 - protein, 374 aa, Homo sapiens [sequence omitted]

SEQ ID NO: 775474 - protein, 257 aa, Homo sapiens
GRVGRPTRRGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 775475 - protein, 739 aa, Homo sapiens; identical to SEQ ID NO: 775469

SEQ ID NO: 775476 - protein, 619 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPRSLRVPSS

SEQ ID NO: 775477 - protein, 581 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEAKDVYKDISNEA

SEQ ID NO: 775478 - protein, 440 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPFNKNFCRRGREFSSS

SEQ ID NO: 775479 - protein, 31 aa, Homo sapiens
MTHAISGIKHHGGTNQAQVHRHKSTSPGSLY

SEQ ID NO: 775480 - protein, 108 aa, Homo sapiens
MGTDEDCYQERGDWDQESGFGREEPRLLFWMCQDRSAFEKSELWYQIASWICETGVWGKERPWLKNVSFGNVNIKPQDWVTWPSRGVGTEKRPWPEPWGHLHLGEKGM

SEQ ID NO: 775481 - protein, 144 aa, Homo sapiens [sequence omitted]

SEQ ID NO: 775482 - protein, 221 aa, Homo sapiens
RTILARLRLSGVPGPAGKQSMAGAGPKRRALAAPVAEEKEEAREKMLASKRADGAAPAGEGEGVTLQRNITLLNGVAIIVGAIIGSGIFVTPTGVLKEAGSPGLALVMWAACGVFSIVGALCYAELGTTISKSGGDYAYMLDVYGSLPAFLKLWIELLVIRPSSQYIVALVFATYLLKPLFPSCPVPEEAAKLMACHCVRPGKEGLAYATLCRIVFSAYRA

SEQ ID NO: 775483 - protein, 120 aa, Homo sapiens
GPGPDHPRWAIDPASGSGDVSNLDPNFSFEGTKLDVGNIVLALYSGLFAYGGWNYLNFVTEEMINPYRNLPLAIQPEAFNGPTIMLVLMTAKIVGDVFIEGLYDMHIQLQSVPFLHWEAP

SEQ ID NO: 775484 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 775485 - protein, 527 aa, Homo sapiens
ARILARLRLSGVPGPAGKQSMAGAGPKRRALAAPVAEEKEEAREKMLASKRADGAAPAGEGEGVTLQRNITLLNGVAIIVGAIIGSGIFVTPTGVLKEAGSPGLALVMWAACGVFSIVGALCYAELGTTISKSGGDYAYMLDVYGSLPAFLKLWIELLVIRPSSQYIVALVFATYLLKPLFPSCPVPEEAAKLMACHCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 775486 - protein, 125 aa, Homo sapiens [sequence omitted]

SEQ ID NO: 775487 - protein, 147 aa, Homo sapiens [sequence omitted]

SEQ ID NO: 775488 - protein, 147 aa, Homo sapiens [sequence omitted]

SEQ ID NO: 775489 - protein, 507 aa, Homo sapiens; identical to SEQ ID NO: 775484

SEQ ID NO: 775490 - protein, 147 aa, Homo sapiens [sequence omitted]

SEQ ID NO: 775491 - protein, 507 aa, Homo sapiens; identical to SEQ ID NO: 775484

SEQ ID NO: 775492 - protein, 147 aa, Homo sapiens [sequence omitted]

SEQ ID NO: 775493 - protein, 147 aa, Homo sapiens [sequence omitted]

SEQ ID NO: 775494 - protein, 153 aa, Homo sapiens
MLSLAALRGAGAMPAPCLCPSHAGPSTVTSADQAGHPLPSNDVCGWDLLYSVLMANLLHWAGLGRVFWLFCGVFIFKETLNHPKKKTKKVQREKAKGANGPRRLSPQQGGYHYAKPGQRPEKDPRTGKPNLAKSERHPAHSPGNETFGDRCRT

SEQ ID NO: 775495 - protein, 153 aa, Homo sapiens; identical to SEQ ID NO: 775494

SEQ ID NO: 775496 - protein, 153 aa, Homo sapiens; identical to SEQ ID NO: 775494

SEQ ID NO: 775497 - protein, 103 aa, Homo sapiens
KSSSVPLLGSLLRIQGAGGLSTARTCLLAAAAVGEHGGCQRLLWKVAASEMAGAAGVRLHTAQVSSGRLSWGGSSSAEGWWGVQSVILGAVCPTPAWGPHFRR

SEQ ID NO: 775498 - protein, 291 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIQRLRGVEWPEALL

SEQ ID NO: 775499 - protein, 241 aa, Homo sapiens
RTILARLRLSGVPGPAGKQSMAGAGPKRRALAAPVAEEKEEAREKMLASKRADGAAPAGEGEGVTLQRNITLLNGVAIIVGAIIGSGIFVTPTGVLKEAGSPGLALVMWAACGVFSIVGALCYAELGTTISKSGGDYAYMLDVYGSLPAFLKLWIELLVIRPSSQYIVALVFATYLLKPLFPSCPVPEEAAKLMACHCVREYGARAGGWEVVVPGSLHPCITTPLAPTSLHFCVPGPSRQF

SEQ ID NO: 775500 - protein, 343 aa, Homo sapiens
PFTRVFVLVRFSLVIMLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 775501 - protein, 364 aa, Homo sapiens
MVELVVSAEVALLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 775502 - protein, 507 aa, Homo sapiens; identical to SEQ ID NO: 775484

SEQ ID NO: 775503 - protein, 147 aa, Homo sapiens [sequence omitted]

SEQ ID NO: 775504 - protein, 507 aa, Homo sapiens; identical to SEQ ID NO: 775484

SEQ ID NO: 775505 - protein, 507 aa, Homo sapiens; identical to SEQ ID NO: 775484

SEQ ID NO: 775506 - protein, 147 aa, Homo sapiens [sequence omitted]

SEQ ID NO: 775507 - protein, 153 aa, Homo sapiens; identical to SEQ ID NO: 775494

SEQ ID NO: 775508 - protein, 183 aa, Homo sapiens
RLYAPLDIVDHALRWCPTCLVHCCVNPGGSGHRRQPRPRVQEKCSLEARTTASHWGRRGPRTTSASYLPASARGPRDAVLFQPPALGRGHASRIQGAGGLSTARTCLLAAAAVGEHGGCQRLLWKVAASEMAGAAGVRLHTAQVSSGRLSWGGSSSAEGWWGVQSVILGAVCPTPAWGPHFRR

SEQ ID NO: 775509 - protein, 507 aa, Homo sapiens; identical to SEQ ID NO: 775484

SEQ ID NO: 775510 - protein, 67 aa, Homo sapiens
MSSLFFPGNLPLAIIISLPIVTLVYVLTNLAYFTTLSTEQMLSSEAVAVVSRYPPASTRGLRGCGQP

SEQ ID NO: 775511 - protein, 324 aa, Homo sapiens
QTNTKDWTVTPEHVLPESQSLLTFEEVAMYFSQEEWELLDPTQKALYNDVMQENYETVISLALFVLPKPKVISCLEQGEEPWVQVSPEFKDSAGKSPTGLKLKNDTENHQPVSLSDLEIQASAGVISKKAKVKVPQKTAGKENHFDMHRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 775512 - protein, 116 aa, Homo sapiens
RLSWSVGLGLSEGEVSLCSAYRKLNTTRDCLESCQPGAALARGNESLMGVLPNTHDSVSQVHTAEQTQGKASGWNLKNAVTRAGCTPAFSLSPVVVVMFDVRRVRCGRVESSQIHA

SEQ ID NO: 775513 - protein, 187 aa, Homo sapiens
LWDSPLESFNTAVEICTLEDPSTEILQPTIIMEEPTSSTNENKMKSPCESNKRKVDKKKNLHRASAPEQSLKETEKAKYPTLVFYCRKNKKRNSNQLENNQPTESSTDPIKEKGDLDISAGSPQDGEEEKDLVFLGARACLEEHIRRSVLYVGDSDTLSKMKTSESPPSGHIPQSGVFCNSPNAVSN

SEQ ID NO: 775514 - protein, 67 aa, Homo sapiens
EKHLCHVPSNEMTTVHSPSFLGAGETPSPRTPKSKYDTSSPPNSGDGDRGGKYVEPWACSLTVTFAT

SEQ ID NO: 775515 - protein, 71 aa, Homo sapiens
IGLCVNMRSLPWYVPANPDSFFPRCYSLCTESEQQEFLEDFRRTMASSILKWVVSHQSCSRSSRSKPRDQR

SEQ ID NO: 775516 - protein, 46 aa, Homo sapiens
VSCKHFVCGASLKSHINLIGRYHHAYFIDRKTKISKKGSDLTKGTD

SEQ ID NO: 775517 - protein, 50 aa, Homo sapiens
MAAGPMESAGALALTCPCILRLCCFSLRGSFLPLVGPCSPETLPLAWGLL

SEQ ID NO: 775518 - protein, 112 aa, Homo sapiens
GQDGLEASNPGGTRRSPTRPGRQLHGPWADARSGCGTRRGAAAWPHPKAAECPELVPGSRRRPSRSWAGSGVGQALPAGLTGRSDPAIRLRLRPGSADPRATLLQWPSRGRN

SEQ ID NO: 775519 - protein, 51 aa, Homo sapiens
FSCCPCPGWARLAVLLALTPSHLEFTCFPSTPRSSSEKGSAQIPWFSDLKQ

SEQ ID NO: 775520 - protein, 301 aa, Homo sapiens
SLWHSVLRPPRLGSQCVAGLSQTPQATLAANGAEDSRGGEMLPAGEIGASPAAPCCSESGDERKNLEEKSDINVTVLIGSKQVSEGTYNFIRNSYKNSSALKNAEESKQFLNQFLEQETHLFSAINSHLLTAQPWMDDLGTMISQIEEIERHLAYLNWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSSEMNYLLSQSNSQKNTLFLPPLLSSCP

SEQ ID NO: 775521 - protein, 360 aa, Homo sapiens
SLWHSVLRPPRLGSQCVAGLSQTPQATLAANGAEDSRGGEMLPAGEIGASPAAPCCSESGDERKNLEEKSDINVTVLIGSKQVSDRVTDYMGESPFILLCLAFHSKQDTSDNGPFNIFNRKAWIKTPLEADGQLSNNGRLRQTQVLTISSEIPKRIRSALKNAEESKQFLNQFLEQETHLFSAINSHLLTAQPWMDDLGTMISQIEEIERHLAYLNWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSSEMNYLLSQSNSQKNTLFLPPLLSSCP

SEQ ID NO: 775522 - protein, 219 aa, Homo sapiens
MASEVPYASGMPIKKIGHRSVDSSGGTTSSALKGAIQLGITHTVGSLSTKPESDVLMQDFHMVESIFFPSEGSNLTPAHHYNAFRFKTYAPVAFRYFWELFGIRPDDYLYSLCSEPLIELCSSGASGSLFYVSSDDEFIVKTVRHKEAEFLQKLLPGYYINLNQNPRTLLPKFYGLYCVQTGGKNIRIVVMNNLLPRSVKMHIKYDLKGSTYRRRASQK

SEQ ID NO: 775523 - protein, 120 aa, Homo sapiens
GCSRTKKQLEGARARGMPEHWVVGRMRIRNSLCPTGTLRRDGSETWVSGHSHSHSSRPWASVPPIPRCWVLPFLSLCAADSGPLAEVPPVNLGHCIPALRCQMSLFIGSSMPWVWSCCAP

SEQ ID NO: 775524 - protein, 217 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFDEYRTGEQGCKNLIHREQDGPVQRTVCLPSNPCSRAKHICRSATLAGWGELYETLRPTTINLRGLQMMPGQNVEDVHGGGTVPLRSGDTHSLERVRGYDFKLLENLSIQYILR

SEQ ID NO: 775525 - protein, 103 aa, Homo sapiens
RLITSEVRSLNPCPRALPLTVAFPGQQEAVALLACVTERTDVLEHRWVIILDVGVQFWLGRNLSHPGNGWVTCIKSWNCPHLLNPSLMKKENSGAMDGSRALQ

SEQ ID NO: 775526 - protein, 133 aa, Homo sapiens
CLPFIYPFLIFIFIFKTSCLSPCLPARSGLFRGRSAGDDHFSLEAFLSGCQILFNFLGFKFKKRREHSNCFLPRIMCLLPHSPSKYKDVQDIIASSKKLKIQIGEDVGAHTKSRLFTSRQLSAVSSWASNLTS

SEQ ID NO: 775527 - protein, 34 aa, Homo sapiens
EELWVAPSGARSPYAGLMMIREVSVTQQMECSNA

SEQ ID NO: 775528 - protein, 33 aa, Homo sapiens
VPERRSKRQGPQEEEEAYESPGRGKEASLSPGE

SEQ ID NO: 775529 - protein, 1084 aa, Homo sapiens
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 775530 - protein, 119 aa, Homo sapiens
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKANTDAG

SEQ ID NO: 775531 - protein, 668 aa, Homo sapiens
MVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 775532 - protein, 1084 aa, Homo sapiens; identical to SEQ ID NO: 775529

SEQ ID NO: 775533 - protein, 1084 aa, Homo sapiens; identical to SEQ ID NO: 775529

SEQ ID NO: 775534 - protein, 1084 aa, Homo sapiens; identical to SEQ ID NO: 775529

SEQ ID NO: 775535 - protein, 208 aa, Homo sapiens
SDGGEKMAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMVRYELPNFFSV

SEQ ID NO: 775536 - protein, 170 aa, Homo sapiens
SDGGEKMAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSVSSLNFFFPGFKILKNCFPKVNCCYL

SEQ ID NO: 775537 - protein, 652 aa, Homo sapiens
SDGGEKMAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPPMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSDILC

SEQ ID NO: 775538 - protein, 462 aa, Homo sapiens
MYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPPMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSDILC

SEQ ID NO: 775539 - protein, 170 aa, Homo sapiens; identical to SEQ ID NO: 775536

SEQ ID NO: 775540 - protein, 143 aa, Homo sapiens
PPPTLSPAAITVGRGEDLTSEHPLLEQVELPAVASVRASVIKSPSDPSHVSVPPPPLLLPAATTGSNSTSMHSSIPSIENKPPQAIVKPQILTHVIEGFVIQEGLEPFPVSRSSLLIEQPVKKRPLLDNQVINSVCVQPELQN

SEQ ID NO: 775541 - protein, 423 aa, Homo sapiens
WQGGNQEDEEDEEEEEDEEDEDEEEDDDDEEVGSSAVFFFLSDKAFNPPVHNSLLLKKKIEMKGCVRFVFKLYSVFFCIVNSTASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPPMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSDILC

SEQ ID NO: 775542 - protein, 220 aa, Homo sapiens
MASAGSTARRAGSGSWHSERGEGRGARPQPTPSGSMQQANKVSLKATWTDAESKQPRWVAGEGVPAAGSENPAQRLPGGQGLERAGAEAAAREARRDRLGPGIASREVPRPWPRVASPLPRPPARRGPGIASREVPGPWPRVASPLPRPPASPCPTSQTTSVRRRLPSPGRAALPRSPRPALTPAPARSPTRRQSTRRRSGATTSCSQRLWATWNGCDSV

SEQ ID NO: 775543 - protein, 572 aa, Homo sapiens
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQGQDAVCTSHLPFPPSHQRLSYGRTFLYYQTVDSFGEEGNCLSKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEGALRMLYPRVWPYRMKVPQGFYPISMREVPRKRHLGDNTFWTDTLAMNLRDTFDEAFLAAVRSHQGLPTLPSPQTNP

SEQ ID NO: 775544 - protein, 379 aa, Homo sapiens
MGFTAIHFAAQWGKLACLQVLVEEYKFPVDLLTNNSQTPLHLVIHRDNTTVALPCIYYLLEKGADLNAFLKDAMWKKDKKDFAREMTKMKMFKSQLTLMEHNYLMSIKVKDAVCTSHLPFPPSHQRLSYGRTFLYYQTVDSFGEEGNCLSKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEGALRMLYPRVWPYRMKVPQGFYPISMREVPRKRHLGDNTFWTDTLAMNLRDTFDEAFLAAVRSHQGLPTLPSPQTNP

SEQ ID NO: 775545 - protein, 148 aa, Homo sapiens
MEKVVSPIGTPAPIRQVLLPSDSDFPSHQTQSFPHPSDCGFRKLQPQDLLAQKQRAAVLHDSLVPSVVAERAQNSQRSCYQKVAPRQAAPRPLSGLQYQASPGHRPLQDPRATGIAAFQELPPLCGCTPAMHSTAHGDAQAHLQEAHG

SEQ ID NO: 775546 - protein, 483 aa, Homo sapiens
MASAGSTARRAGSGSWHSERGEGRGARPQPTPSGSMQQANKVSLKATWTDAESKQPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAFLKDAMWKKDKKDFAREMTKMKMFKSQLTLMEHNYLIEYQGQDAVCTSHLPFPPSHQRLSYGRTFLYYQTVDSFGEEGNCLSKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEGALRMLYPRVWPYRMKVPQGFYPISMREVPRKRHLGDNTFWTDTLAMNLRDTFDEAFLAAVRSHQGLPTLPSPQTNP

SEQ ID NO: 775547 - protein, 329 aa, Homo sapiens
MTIYGRLRGGKDRARLSCCHRAWRASQLYPPYMTSQGPHFQEACPHQAIQSFLLSLSRVKDAVCTSHLPFPPSHQRLSYGRTFLYYQTVDSFGEEGNCLSKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEGALRMLYPRVWPYRMKVPQGFYPISMREVPRKRHLGDNTFWTDTLAMNLRDTFDEAFLAAVRSHQGLPTLPSPQTNP

SEQ ID NO: 775548 - protein, 876 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775549 - protein, 272 aa, Homo sapiens
RRWRPGVNRTRRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVGGEPK

SEQ ID NO: 775550 - protein, 208 aa, Homo sapiens
SLAPSLRAASHSQPPFLLSPSASRAPARSELPPGSLPRRQQPIWREEVREEERKGSRTDYPDRAGEWVCGDPCVYVDSDISMVVCRQRTHSVILSFPNIHASVHTSITSQVLSNTMGDLPVGVLRLSSQWLQHQAWFFSYPQYFGAHVARVHGLIDLRSPPISVQQHSWTSIGHSLLLISRHDPSPHAVTLSPPIRSQTDTSYYFNTV

SEQ ID NO: 775551 - protein, 289 aa, Homo sapiens
PTRRTSYTGYAHPNRINGLADWALVLPRYNQKPSLLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMELRVTYSTRHIRIRNPSQWTFSPEHLSKSFRNVFEEVQTSRWLRKSQNGGIGYPGYEDVPKTQITAIDEDTKMQIGGTTGECEERYPKNEG

SEQ ID NO: 775552 - protein, 104 aa, Homo sapiens
MKKARKQLNQQERNHDRVNTDNEGKQQRHTEGGKKTRIDTTEDQLRDRDKRIPEGYKSEMAKENPKGQLSRQSYKEKTQTDKGGQPVGGPKEEERNKDTSEKYP

SEQ ID NO: 775553 - protein, 876 aa, Homo sapiens; identical to SEQ ID NO: 775548

SEQ ID NO: 775554 - protein, 876 aa, Homo sapiens; identical to SEQ ID NO: 775548

SEQ ID NO: 775555 - protein, 876 aa, Homo sapiens; identical to SEQ ID NO: 775548

SEQ ID NO: 775556 - protein, 876 aa, Homo sapiens; identical to SEQ ID NO: 775548

SEQ ID NO: 775557 - protein, 876 aa, Homo sapiens; identical to SEQ ID NO: 775548

SEQ ID NO: 775558 - protein, 876 aa, Homo sapiens; identical to SEQ ID NO: 775548

SEQ ID NO: 775559 - protein, 876 aa, Homo sapiens; identical to SEQ ID NO: 775548

SEQ ID NO: 775560 - protein, 829 aa, Homo sapiens
MYPRHCAFAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775561 - protein, 696 aa, Homo sapiens
MRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775562 - protein, 731 aa, Homo sapiens
LRLVRAGVEFGRGQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775563 - protein, 734 aa, Homo sapiens
RKSLAGRSRFGIQSAGRSSHSQLLDSWPVKILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775564 - protein, 876 aa, Homo sapiens; identical to SEQ ID NO: 775548

SEQ ID NO: 775565 - protein, 927 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDSRDRVSPCWTGWSRSPDPRDPPAFAPQSARITGMSHHARPTTIFLYRMKNLGPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775566 - protein, 805 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFADENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775567 - protein, 775 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775568 - protein, 509 aa, Homo sapiens
LGSEAGCIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775569 - protein, 460 aa, Homo sapiens
AEIEQYRLQEGAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775570 - protein, 892 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRNWTPAGLVLGVYWALGIPFQPG

SEQ ID NO: 775571 - protein, 380 aa, Homo sapiens
YGLGEAGVYRPREAPERLQTPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775572 - protein, 797 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPRIVDCLVTNPRS

SEQ ID NO: 775573 - protein, 258 aa, Homo sapiens
KVNIGYMSWGYRTRRHWWNMLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775574 - protein, 835 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNESGELHGLTTEEEFVEGIYKVEIDTKSYWKALGISPFHEHAEVVFTANDSGPRRYTIAALSPYSYSTTAVVTNPKE

SEQ ID NO: 775575 - protein, 285 aa, Homo sapiens
VTVICGVCVGNGARGMISSFVCEVRKGFWNQGVIDVIWSYRNTVEGVALDTVPASGESDWVSVFSHREEEWLMQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775576 - protein, 641 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVWGG

SEQ ID NO: 775577 - protein, 151 aa, Homo sapiens
LGQGRVLIGRGNTLQQVSQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775578 - protein, 642 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQESASGGHLSCLALWGVAPLVFQPRSAVKEPVVPAGGGPPRGLPAWVTPPSGAP

SEQ ID NO: 775579 - protein, 609 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQGMVVPYDLITPGWRIISISV

SEQ ID NO: 775580 - protein, 106 aa, Homo sapiens
MSHRTRPIPSLSFIADVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775581 - protein, 119 aa, Homo sapiens
DGYGVGWQAQSPGADEGNHGGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775582 - protein, 518 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVKKSSRLRGDPL

SEQ ID NO: 775583 - protein, 114 aa, Homo sapiens
QKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 775584 - protein, 491 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWVRDFLAGEKRSLPAPLARK

SEQ ID NO: 775585 - protein, 418 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQVKLRDFWSRK

SEQ ID NO: 775586 - protein, 285 aa, Homo sapiens; identical to SEQ ID NO: 775575

SEQ ID NO: 775587 - protein, 236 aa, Homo sapiens
NKRRRAGLNRQRETPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVWGG

SEQ ID NO: 775588 - protein, 144 aa, Homo sapiens
SLAPSLRAASHSQPPFLLSPSASRAPARSELPPGSLPRRQQPIWREEVREEERKGSRTDYPDRAGEWVCGDPSHVRTRRTVIPGGGQGDPGGRMWARLSMIPTPPLIKMLTESDCRYALYDATYETQGEQEGGSGCNLLVTPEI

SEQ ID NO: 775589 - protein, 125 aa, Homo sapiens
CGAAKENLPTFLVELSRVLANPGNSQVARVAAGLQIKNSLTSKDPDIKAQYQQRWLAIDANARREVKNYVLQTLGTETYRPSSASQCVAGIACAEIHICCQEYCISELVKIEHLKNIQTLQDSRL

SEQ ID NO: 775590 - protein, 876 aa, Homo sapiens; identical to SEQ ID NO: 775548

SEQ ID NO: 775591 - protein, 876 aa, Homo sapiens; identical to SEQ ID NO: 775548

SEQ ID NO: 775592 - protein, 876 aa, Homo sapiens; identical to SEQ ID NO: 775548

SEQ ID NO: 775593 - protein, 731 aa, Homo sapiens
MKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775594 - protein, 730 aa, Homo sapiens
TRLGTRPGVIYCQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775595 - protein, 876 aa, Homo sapiens; identical to SEQ ID NO: 775548

SEQ ID NO: 775596 - protein, 852 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMENVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775597 - protein, 584 aa, Homo sapiens
GREVNGRAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775598 - protein, 489 aa, Homo sapiens
MAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775599 - protein, 505 aa, Homo sapiens
RRWRPGVNRTRRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775600 - protein, 876 aa, Homo sapiens; identical to SEQ ID NO: 775548

SEQ ID NO: 775601 - protein, 431 aa, Homo sapiens
CQIIKQDDERCQIIRQDFCDWKQKKWQAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775602 - protein, 299 aa, Homo sapiens
MTSLLLDQSITPCASGLVPTLNALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775603 - protein, 785 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHR

SEQ ID NO: 775604 - protein, 259 aa, Homo sapiens
TPDKVMKELDENGDGEVDFQVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775605 - protein, 211 aa, Homo sapiens
MLDEKSRTMFCRHWVQKLTGLVLPHSVWLVLLVQRSNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 775606 - protein, 48 aa, Homo sapiens
TQKLKALITSRPAVEKCSRKSFKNEENDARYKNINLHKEEQAEMVTAQ

SEQ ID NO: 775607 - protein, 82 aa, Homo sapiens
DSRGSRSARTNLELCASYVYLSMSYCFDRDDVALKNFAKYFLHQSHEEREHAEKLMKLQNQRGGRIFLQDIKKPDCDDWESG

SEQ ID NO: 775608 - protein, 131 aa, Homo sapiens [sequence omitted]

SEQ ID NO: 775609 - protein, 79 aa, Homo sapiens
FNSHLTYSVLFNLTGSPMLIFSSPMKTFGFIPDMVWLCPYPNLILSCSSHNSHMSWEGTRWDATESWEQVFPILILDSE

SEQ ID NO: 775610 - protein, 123 aa, Homo sapiens
RLLRAPPSSRRPPNPAPRDSVFPSAGSGQSRKGSRAGRLADRDRPGPGSRVTCRGLSRALMRMIQKGGEANGAVESRVPEQVSRDGGPCPCRKRAPHCFMMEGRTPGPGCRQVSQRMSFMTTS

SEQ ID NO: 775611 - protein, 113 aa, Homo sapiens
LCAIALSALGTLTSGLCAVALSALGTLTSGLCAVALCALGTLPQTCASHSLSSALCSNVTSFLTSSLTILAKIPPPRPSLSLDPALLFFITLSIATWNNNDRLFLFVFYLCSH

SEQ ID NO: 775612 - protein, 124 aa, Homo sapiens
MRAWLSLLGPGARPALLQPSLAPFSLPPILPHQEPSLPPQASTPHSRGAPLLTPSVAVCGVEQEERDRHVLTVACSRRCVHSGLSPALGMSLSPNHCPSCGGTCEVHCPGEQGLRAELGTPPLS

SEQ ID NO: 775613 - protein, 151 aa, Homo sapiens
MTAFNSGKVDIVAINDPFIDLNYMVYMFLYDSTHGKFHGTVKAENGTLVIMETPSPIFQDQDPSKIKWGDAGAEYVVEFTGVFTTMEKAGAHLQGGAKRVNISVLSVDAPMFVMGVNHEKYDNSLKIVSNASCITNCLAPQPRSSMTTLVS

SEQ ID NO: 775614 - protein, 110 aa, Homo sapiens
MQFQISRPNRPLRQDRLLCLGIESKLIHSYLRGLPRHSSLQVCGEARLSTDLPKTPLQWLEHRSSSENQLSPVKPDTEQTGKGKNSAYSSQIFRSGNDNLIVLIKNIICE

SEQ ID NO: 775615 - protein, 99 aa, Homo sapiens
LLGYVQRTLNGSTMKTHALKCPLQHHSQQHRHGIKLGPVSGRRIKRMWSIYTAEYYAAIKRNKIMPFAGTWMELEAIILRKLMRGQNPGHYTSPLTSGS

SEQ ID NO: 775616 - protein, 99 aa, Homo sapiens; identical to SEQ ID NO: 775615

SEQ ID NO: 775617 - protein, 92 aa, Homo sapiens
KFPVQKEKIDRCSGKKLEDGPKFLKSGDAAIVDTVPGKPLCVESFSDYPPVGRFAVHDLRQTVVVGVIKAVDKKAAEAGKVTKPAQKAQKAK

SEQ ID NO: 775618 - protein, 172 aa, Homo sapiens
GNDGDRVKFGFFLVFVFAGLHHGSPNRKPRMKQTGNARALVANAQPCKSAREAEQSQVEVVSYWAGLGISPLSSGVCSLESRVCHASEGLGSISPQDDPMFRWARRRHCPQPQLSMLTTYHKSTSLQLSGLAYEPQAHREGCGWGISHLHLVCWVKSNWCQCSPSHRETCSL

SEQ ID NO: 775619 - protein, 117 aa, Homo sapiens
MVCGGNGERQLAVTAAPCLATGRKEGESTYHRLEARACRTAAGLAGSPPWLASLWLVAATDTAAGQSVERQWGAQSWWAQRFLWIGARQCDVTSHHSRSQFLARLSQKERLDFGGWI

SEQ ID NO: 775620 - protein, 96 aa, Homo sapiens
QLLCSYRIRRNGIIVSLIYVNKLKNCLKENMNELMNSTGEDLQLDKSTLSARAVKAKGPVMIPYPFFQSHVEDFYVEGLPKGIFFFFFFGDGVFTL

SEQ ID NO: 775621 - protein, 112 aa, Homo sapiens
FLSISKFLLGTQRLIAWGGHIPVLVPYMVLVCSHHGLSILVGIQTGDKSAISAKEKTEAGGPLCVGLLSESGGGKTWGGAAWLQCQLGEKYGQRELPRPHVFLQPVGCEGRQ

SEQ ID NO: 775622 - protein, 119 aa, Homo sapiens
ADSPVWEKEMEVGEPGYPQLGKASFKAFPCWMPAQERGKQLILGFEGKGNTQVLTDTLAPHLPLQWGPPTFLFSPFLWAKKLRLREMRSQSGGEEGPVSFLLRQTGSPVGPSHHTSSLL

SEQ ID NO: 775623 - protein, 86 aa, Homo sapiens
RGLSGPPGSGVAPAPVPRALPRHGLSPRPLPSQILASGTAEPAALANKPVRPTGLGTLERSPSPGLPCALDPSTLLRRPPTTERRA

SEQ ID NO: 775624 - protein, 86 aa, Homo sapiens; identical to SEQ ID NO: 775623

SEQ ID NO: 775625 - protein, 86 aa, Homo sapiens; identical to SEQ ID NO: 775623

SEQ ID NO: 775626 - protein, 86 aa, Homo sapiens; identical to SEQ ID NO: 775623

SEQ ID NO: 775627 - protein, 86 aa, Homo sapiens; identical to SEQ ID NO: 775623

SEQ ID NO: 775628 - protein, 86 aa, Homo sapiens; identical to SEQ ID NO: 775623

SEQ ID NO: 775629 - protein, 104 aa, Homo sapiens
MPLARDLLHPSLEEEKKKHKKKRLVQSPNSYFMDVKCPGCYKITTVFSHAQTVVLCVGCSTVLCQPTGGKARLTEGISFGILQPSDEIDDYKMSLSSLKSLKKS

SEQ ID NO: 775630 - protein, 50 aa, Homo sapiens
MKVINRFRKITLLSDVLLLPRMTVIPVFACIFHVWLNVPALWFKTNSNNM

SEQ ID NO: 775631 - protein, 86 aa, Homo sapiens; identical to SEQ ID NO: 775623

SEQ ID NO: 775632 - protein, 86 aa, Homo sapiens; identical to SEQ ID NO: 775623

SEQ ID NO: 775633 - protein, 86 aa, Homo sapiens; identical to SEQ ID NO: 775623

SEQ ID NO: 775634 - protein, 86 aa, Homo sapiens; identical to SEQ ID NO: 775623

SEQ ID NO: 775635 - protein, 86 aa, Homo sapiens; identical to SEQ ID NO: 775623

SEQ ID NO: 775636 - protein, 86 aa, Homo sapiens; identical to SEQ ID NO: 775623

SEQ ID NO: 775637 - protein, 125 aa, Homo sapiens
MPLARDLLHPSLEEEKKKHKKKRLVQSPNSYFMDVKCPGCYKITTVFSHAQTVVLCVGCSTVLCQPTGGKARLTEGCKCVNLTKKEKVPAIPALWEAETGGLLELQDFETSLSNVAETASLQNIQ

SEQ ID NO: 775638 - protein, 134 aa, Homo sapiens
MGMNKSIKLLHESNIITHQEPFSPQPIEPHHPPVFPSLPSLFPSVCIAGAFLLTTPFPLCTLASPLMIPHRCQHQLGSPMGARASGGLLTQVGHSPQPLWVLGIFDFPLLALGSSLMRGWGPQGRSSDLLCVCL

SEQ ID NO: 775639 - protein, 576 aa, Homo sapiens
MEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKLQRWRK

SEQ ID NO: 775640 - protein, 602 aa, Homo sapiens
MEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 775641 - protein, 566 aa, Homo sapiens
MEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKKLCRPLPWKSTVPPCIGVAKTTGDCRSKTCLD

SEQ ID NO: 775642 - protein, 602 aa, Homo sapiens; identical to SEQ ID NO: 775640

SEQ ID NO: 775643 - protein, 602 aa, Homo sapiens; identical to SEQ ID NO: 775640

SEQ ID NO: 775644 - protein, 602 aa, Homo sapiens; identical to SEQ ID NO: 775640

SEQ ID NO: 775645 - protein, 566 aa, Homo sapiens; identical to SEQ ID NO: 775641

SEQ ID NO: 775646 - protein, 584 aa, Homo sapiens
MEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQVESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 775647 - protein, 602 aa, Homo sapiens; identical to SEQ ID NO: 775640

SEQ ID NO: 775648 - protein, 602 aa, Homo sapiens; identical to SEQ ID NO: 775640

SEQ ID NO: 775649 - protein, 300 aa, Homo sapiens
VTRGSTHASAGGWWMGGERSGVRGNKMAAAEPSPRRVGFVGAGRMAGAIAQGLIRAGKVEAQHILASAPTDRNLCHFQALGCRTTHSNQEVLQSCLLVIFATKPHVLPAVLAEVAPVVTTEHILVSVAAGVSLSTLEELLPPNTRVLRVLPNLPCVVQEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 775650 - protein, 300 aa, Homo sapiens; identical to SEQ ID NO: 775649

SEQ ID NO: 775651 - protein, 258 aa, Homo sapiens
LEAEAPGICVLTNGGKVEAQHILASAPTDRNLCHFQALGCRTTHSNQEVLQSCLLVIFATKPHVLPAVLAEVAPVVTTEHILVSVAAGVSLSTLEELLPPNTRVLRVLPNLPCVVQEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 775652 - protein, 121 aa, Homo sapiens
PPKGPRTLAFNPLGGEGPGRTASAPSPAPQDSPGPPVPRWPQLLQLSASAQQPLEVRREHALSEAGRRVLLCHLPVRLSRSIHQCKTGLTAPAGQQHAPSLMLSCLCGHGLLPFICSLLLS

SEQ ID NO: 775653 - protein, 300 aa, Homo sapiens; identical to SEQ ID NO: 775649

SEQ ID NO: 775654 - protein, 88 aa, Homo sapiens
VTRGSTHASAGGWWMGGERSGVRGNKMAAAEPSPRRVGFVGAGRMAGAIAQGLIRAGKVEAQHILASAPTDRNLCHFQSLTLLSLARP

SEQ ID NO: 775655 - protein, 105 aa, Homo sapiens
FLRCSLALSPRLKCRGAIEITGTHHHTQLIFVCFVETGFHYVGQAGLELLTSSNPPTSASQSVEITGRSHCTQPHSYYMCMKHSTECTIFWGFRQASALKSQNMF

SEQ ID NO: 775656 - protein, 110 aa, Homo sapiens
LLVTRPSRANSLTLMFSRTSYSRAWCYPSAPVCVSSNSRCSRIQLRSSICRAQGASTSLRLVSKLVFRFLIESRLISKDWTISLSSVSIISTAPTSADCVVTTVVLSSIC

SEQ ID NO: 775657 - protein, 56 aa, Homo sapiens
MGLRGQPGLLGFTFCFPTPALPVWLCWPSTEEAHGFGGQMTAHWRAVPLSEGRHLD

SEQ ID NO: 775658 - protein, 513 aa, Homo sapiens
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 775659 - protein, 497 aa, Homo sapiens
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 775660 - protein, 103 aa, Homo sapiens
RPLHRVVSSWRLGAFVASSFLADPSELWEVAAPWRLPRARGANRGSSAWVAGPGLGQGLAFPMVGGSDRPSAGPSRWDKADRLGGWSRYPGARRWTSPIFKRR

SEQ ID NO: 775661 - protein, 85 aa, Homo sapiens
EFRQSDEENEDPLVPTSVAALKSQLTPLSSSQESYLPPPAYSPRFQPRGLEGPGGLEGRLQATGQARPPAPRPFHHGQYYGYLSS

SEQ ID NO: 775662 - protein, 32 aa, Homo sapiens
MASLLPEFSSFILPSCAVQDVPFLGSTATRLS

SEQ ID NO: 775663 - protein, 76 aa, Homo sapiens
ESVQWCSVKGKEHFGAKADKTAQSSQAWVMIPLPRHLRSCHIDVLSLFRLSWNDRNNSGTMTSLTRPRYGSGRGEL

SEQ ID NO: 775664 - protein, 116 aa, Homo sapiens
SDLEDAFCVPFHCCLLPSQGTPGLTKETWSLVVRWSSPGNIQLMAFCPAGMRQRGPGTLGALFTRSRESAWKFQEGHRKASDLEPQCFIFFPFSLLFHPFPHGRWGCHRSLGKESK

SEQ ID NO: 775665 - protein, 36 aa, Homo sapiens
MPYLLWTIKRDIIDYHSLTYDQMLNHYAKTASFTTK

SEQ ID NO: 775666 - protein, 70 aa, Homo sapiens
ASHKGLKWQVDGKLHSLTSARGLLLSHELLLFPLLVSSLLSLLLEWPDPGKRAGERREAIEPHGPLQPGI

SEQ ID NO: 775667 - protein, 142 aa, Homo sapiens
MKPLIWTWSDVEGQRPALLICTAAAGPTQGVKGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 775668 - protein, 443 aa, Homo sapiens
RPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 775669 - protein, 124 aa, Homo sapiens
MKPLIWTWSDVEGQRPALLICTAAAGPTQGVKAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 775670 - protein, 356 aa, Homo sapiens
RPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELQMQKWGFMWGPCSLSVQHLWLWQTWSDVEGQRPALLICTAAAGPTQGVKGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 775671 - protein, 174 aa, Homo sapiens
RGAGAGRGGEGTRHWGNPEFQPGSQGFLPGFLPENFSPPPGSLDGAVRSRGEVGVWEGAAGRERESGWVGDLLSRSWVSPQRGATDPQAFPALQMERHRDAPQVAALGCQPVSGRGGCRQEAPVSETPLSPKLRQQKTLRRPEGLVNHRGAQLRLVSSSRWRWRVLNAAGFELD

SEQ ID NO: 775672 - protein, 382 aa, Homo sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 775673 - protein, 204 aa, Homo sapiens
MPFSFQVQHPSLCTPRVQCIRGSQRVPQPPAARSPRGPRAGGGGGDAGGGGAPVRRARGGGCWARAYQDARCFGRGEGGDLQVSSGPGAAPPAEFRASARSAQGSRDVPAGPGFPPRLPRPFTSASFSNQTRLRRRSASALPAPRLCPQRASPGCSSPGVRGPGGGASPRARGGNAAAALAARQAAGGGRSRSAFVAGRDAALA

SEQ ID NO: 775674 - protein, 375 aa, Homo sapiens [sequence omitted]

SEQ ID NO: 775675 - protein, 375 aa, Homo sapiens [sequence omitted]

SEQ ID NO: 775676 - protein, 338 aa, Homo sapiens
MVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 775677 - protein, 158 aa, Homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 775678 - protein, 158 aa, Homo sapiens; identical to SEQ ID NO: 775677

SEQ ID NO: 775679 - protein, 171 aa, Homo sapiens
SRVSPSYLLNPSKMAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 775680 - protein, 153 aa, Homo sapiens
SRVSPSYLLNPSKMAARSVSGITRRVFMWTVSGTPCREFWSRFRKEKEPVVVETVEETEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 775681 - protein, 158 aa, Homo sapiens; identical to SEQ ID NO: 775677

SEQ ID NO: 775682 - protein, 158 aa, Homo sapiens; identical to SEQ ID NO: 775677

SEQ ID NO: 775683 - protein, 158 aa, Homo sapiens; identical to SEQ ID NO: 775677

SEQ ID NO: 775684 - protein, 158 aa, Homo sapiens; identical to SEQ ID NO: 775677

SEQ ID NO: 775685 - protein, 159 aa, Homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNYIEITVFP

SEQ ID NO: 775686 - protein, 872 aa, Homo sapiens
MGSLLALLALLPLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTEASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNLKYAAPFRPADTHNEVRFDRFGDGIGRYNIFTYLRAGSGRYRYQKVGYWAEGLTLDTSLIPWASPSAGPLPASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGAQRPRFISPASQVAICLALISGQLLIVVAWLVVEAPGTGKETAPERREVVTLRCNHRDASMLGSLAYNVLLIALCTLYAFKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 775687 - protein, 445 aa, Homo sapiens
MLAPFRPADTHNEVRFDRFGDGIGRYNIFTYLRAGSGRYRYQKVGYWAEGLTLDTSLIPWASPSAGPLPASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGAQRPRFISPASQVAICLALISGQLLIVVAWLVVEAPGTGKETAPERREVVTLRCNHRDASMLGSLAYNVLLIALCTLYAFKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 775688 - protein, 241 aa, Homo sapiens
MLAPFRPADTHNEVRFDRFGDGIGRYNIFTYLRAGSGRYRYQKVGYWAEGLTLDTSLIPWASPSAGPLPASRCSEPCLQNEVKSVQPGEVCCWLCIPCQPYEYRLDEFTCADCGLGYWPNASLTGCFELPQEYIRWGDAWAVGPVTIACLGALATLFVLGVFVRHNATPVVKASGRELCYILLGGVFLCYCMTFIFIAKPSTAVCTLRRLGLGTAFSVCYSALLTKTNRIARIFGGAREGA

SEQ ID NO: 775689 - protein, 34 aa, Homo sapiens
GPSDLGAFLPTGAGTRSSFVLLVPMKDWEPPSGS

SEQ ID NO: 775690 - protein, 31 aa, Homo sapiens
NIYFSGLWQPVICVLPLWFCLFEDVIQMESD

SEQ ID NO: 775691 - protein, 234 aa, Homo sapiens
MKKQGVNPKPLQSSRPSPSKRPYGASPARELEVEKSALGGGKLPGGARRSSPGRIPNLKKRKGLELKVVAKTLLDPFQFVRNSLAQLREEVHELQARWFPSRTTLSIAIFVAILHWLHLVTLFENDRHFSHLSSLEWEMTFRTKMGLYYSYFKTIIEAPSFLEGLWMIMNDRLTEYPLVINTVKRFHLYPEVIIAAWYRTFIGIMNLFGLETKTCWNVTRIEPLNEFKAVKACF

SEQ ID NO: 775692 - protein, 122 aa, Homo sapiens
MSSYFWAQNESNRPDLLCGQPADYLVEEKHFTTLVCFIVVLGGLLKMCLKNCEVIVLTILSLSGFVIGHMAYNSVEVHQIVYPLLRTSSFSLYSYFSPLIIFMVALDVEFYTLKKMFWQVRT

SEQ ID NO: 775693 - protein, 78 aa, Homo sapiens
KTIGLGKRGWVSISNRLILHLETAFILKEKLQVPSPATQPQDGDAAAAAFRTGWPLRCGRGTSISSWEVPQSSGAGEF

SEQ ID NO: 775694 - protein, 109 aa, Homo sapiens
MFKQLSCISLPSSCDYSSRSLLQPPSPKMVMLLLLLSALAGLFGAAEGQAFHLGKCPNPPVQENFDVNKYLGRWYEIEKIPTTFENGRCIQGQLLTNGKRKDQSVKPGS

SEQ ID NO: 775695 - protein, 91 aa, Homo sapiens
LKRDLTLLFTTATVMPSAPYWILATDYENYALVYSCTCIIQLFHVDFAWILARNPNLPPETVDSLKNILTSNNIDVKKMTVTDQVNCPKLS

SEQ ID NO: 775696 - protein, 90 aa, Homo sapiens
LLATTLLIFTATLMPSAPYWILATDYENYALVYSCTCIIQLFHVDFAWILARNPNLPPETVDSLKNILTSNNIDVKKMTVTDQVNCPKLS

SEQ ID NO: 775697 - protein, 103 aa, Homo sapiens
MISAKLCSPGARYMICCQLEVKFSWFMPSAPYWILATDYENYALVYSCTCIIQLFHVDFAWILARNPNLPPETVDSLKNILTSNNIDVKKMTVTDQVNCPKLS

SEQ ID NO: 775698 - protein, 103 aa, Homo sapiens
MPSAPYWILATDYENYALVYSCTCIIQLFHVDFAWILARNPNLPPETVDSLKNILTSNNIDVKKMTVTDQVKRLHPLHVTSASLSPTPPPRHKDKPINHDKGS

SEQ ID NO: 775699 - protein, 76 aa, Homo sapiens
SMGLGSEAWVISNRLILHLETAFILKEKLQVPSPATQPQDGDAAAAAFRTGWPLRCGRGTSISSWEVPQSSGAGEF

SEQ ID NO: 775700 - protein, 69 aa, Homo sapiens
SRDPGVPWERTALSWECPISGAGEFDVNKYLGRWYEIEKIPTTFENGRCIQGQLLTNGKRKDQSVKPGS

SEQ ID NO: 775701 - protein, 125 aa, Homo sapiens
MSNEKIQKLKGADQAISYERRSSVTEWSCNVIIKWSTSTPSCQWSSPVMPSAPYWILATDYENYALVYSCTCIIQLFHVDFAWILARNPNLPPETVDSLKNILTSNNIDVKKMTVTDQVNCPKLS

SEQ ID NO: 775702 - protein, 79 aa, Homo sapiens
MPSAPYWILATDYENYALVYSCTCIIQLFHVDFAWILARNPNLPPETVDSLKNILTSNNIDVKKRRHEMVHELDSLPSS

SEQ ID NO: 775703 - protein, 189 aa, Homo sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 775704 - protein, 205 aa, Homo sapiens
ALSCGQNPLPIYLTINVKDDVSNQDFREWFEFSPYEVGLQKYGAFIPSELFGSEFFMGRLVKRIPESRICYMLGLWSSIFSLNLLDAWNLSHTSEEFFHRWTREKVQDIEDEPILPEIPKCDANILETTVVIPGSWLSNSFREILTHRSFVSEFHNFLSGLQLHTNYLQNGQFSRWKGNPTWLLLEACLHMEEEDVDVKAAMDKE

SEQ ID NO: 775705 - protein, 168 aa, Homo sapiens
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGYAGLVRAPSDWGRQVTRNFNTVGGQKA

SEQ ID NO: 775706 - protein, 85 aa, Homo sapiens
PGIPCSLVPALELFGAQLCGPGSSGRRRGLCSAGAGRRVGLLPPLISRFVPFHWSFPDRVLDGALGAVGPHASLISTLPRNHAVL

SEQ ID NO: 775707 - protein, 57 aa, Homo sapiens
MVSHSELRKLFYSADAVCFDVDSTVIREEGIDWEADIAVSRDHTTALQPGQQSETLS

SEQ ID NO: 775708 - protein, 225 aa, Homo sapiens
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 775709 - protein, 225 aa, Homo sapiens; identical to SEQ ID NO: 775708

SEQ ID NO: 775710 - protein, 225 aa, Homo sapiens; identical to SEQ ID NO: 775708

SEQ ID NO: 775711 - protein, 225 aa, Homo sapiens; identical to SEQ ID NO: 775708

SEQ ID NO: 775712 - protein, 225 aa, Homo sapiens; identical to SEQ ID NO: 775708

SEQ ID NO: 775713 - protein, 203 aa, Homo sapiens
RTRGSTHASGELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 775714 - protein, 180 aa, Homo sapiens
MVSHSELRKLFYSADAVCFDVDSTVIREEGIDELAKICGVEDAVSEMELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 775715 - protein, 161 aa, Homo sapiens
RLCRADRSGVSSLQKHLQNSSEATPLISRSQESVRWRPWVCTAHLPGNCSPERRSRRWPPAAGRLQPQEPRRPRTQGEYAGFDETQPTAESGGKGKVIKLLKEKFHFKKIIMIGDGATDMEACPPADAFIGFGGNVIRQQVKDNAKWYITDFVELLGELEE

SEQ ID NO: 775716 - protein, 85 aa, Homo sapiens; identical to SEQ ID NO: 775706

SEQ ID NO: 775717 - protein, 225 aa, Homo sapiens; identical to SEQ ID NO: 775708

SEQ ID NO: 775718 - protein, 87 aa, Homo sapiens
HAWGAQAPWLASAKVAVGCPQASAWPPPPISYQEELYDFPSCGKWRARSQGSAEASQWPAPAAAPAAHSPHLSLGGKFFQRWSPTQS

SEQ ID NO: 775719 - protein, 225 aa, Homo sapiens; identical to SEQ ID NO: 775708

SEQ ID NO: 775720 - protein, 225 aa, Homo sapiens; identical to SEQ ID NO: 775708

SEQ ID NO: 775721 - protein, 225 aa, Homo sapiens; identical to SEQ ID NO: 775708

SEQ ID NO: 775722 - protein, 225 aa, Homo sapiens; identical to SEQ ID NO: 775708

SEQ ID NO: 775723 - protein, 225 aa, Homo sapiens; identical to SEQ ID NO: 775708

SEQ ID NO: 775724 - protein, 180 aa, Homo sapiens; identical to SEQ ID NO: 775714

SEQ ID NO: 775725 - protein, 87 aa, Homo sapiens; identical to SEQ ID NO: 775718

SEQ ID NO: 775726 - protein, 85 aa, Homo sapiens; identical to SEQ ID NO: 775706

SEQ ID NO: 775727 - protein, 37 aa, Homo sapiens
EDAAVLGNGFRSALWRVDMVQTLGEPGSALGPSLGHC

SEQ ID NO: 775728 - protein, 223 aa, Homo sapiens [sequence omitted]

SEQ ID NO: 775729 - protein, 113 aa, Homo sapiens
ACLLRGCTQNVCCSSLSSLSTLLLSVDPEVWNVSRLTIAKHHIPVKITLQNPSISLHQSQYPLNPASLRGLKPTICKLLQAQVLKPVNSPHNTPILAVKKTRWVLLLGPRSLS

SEQ ID NO: 775730 - protein, 101 aa, Homo sapiens
KRFHHVAQAGLELGSGDPPPSASHSAGITGVNHHARSIFFKETTPSSERVSMRQGHSEQPGLRTANPRSTCSPRVNPCFQEQGLEDTFSGNPVPRAGTVLT

SEQ ID NO: 775731 - protein, 61 aa, Homo sapiens
MPPAAVACFSRPLLALCTQVSLSPRTPPCQHRILTKGEPRQPTAILGRRGLCGASRGPGCL

SEQ ID NO: 775732 - protein, 147 aa, Homo sapiens
KWGYEYPHVTDENVRPKAQNQGCPSMPVVHLWLFPWPLCSTGTREAHRVSLHTTSHPLSLRKGWQSLQVRVGVGRGGQSSALHFCHVVAVTGEKMPKSFLEEAASRRLHHILVLPSGHEWIRRFPLGEKAQKPPQRMAEVGEASHRG

SEQ ID NO: 775733 - protein, 105 aa, Homo sapiens
APVTSALLFFLHRLPGSTHLQRSSPSQEAPDIPVTWSTLAARPPSLGAEVGGLEGSVKGPPCPHVTCFCHRCRQCGQASRSTSSVHSAPVCSDAPCCGLFLRMFC

SEQ ID NO: 775734 - protein, 268 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAGECPPGTVGS

SEQ ID NO: 775735 - protein, 172 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNGSWPWHFRGQPAVRVAGAGTGVEAGRIVSGDCSRCRRDTGLGGGSIWV

SEQ ID NO: 775736 - protein, 363 aa, Homo sapiens
IGGRGWFNRPRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775737 - protein, 307 aa, Homo sapiens
PGKKEVVFVFFIKKVGQTRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEATSTRTSY

SEQ ID NO: 775738 - protein, 214 aa, Homo sapiens
YSGLSSNLGSLQPLFLQVFSLSLNPTSGTGREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775739 - protein, 192 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWKSTRTSLAPRT

SEQ ID NO: 775740 - protein, 365 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775741 - protein, 236 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEAATAEESWHINRPDRQAAQAQTLSQDPGMTV

SEQ ID NO: 775742 - protein, 371 aa, Homo sapiens
PGKKEVVFVFFIKKVGQTRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775743 - protein, 371 aa, Homo sapiens; identical to SEQ ID NO: 775742

SEQ ID NO: 775744 - protein, 182 aa, Homo sapiens
PGKKEVVFVFFIKKVGQTRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPGSSCITKRKFTSTTSCWRP

SEQ ID NO: 775745 - protein, 304 aa, Homo sapiens
RLVRRQRKMAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 775746 - protein, 76 aa, Homo sapiens
MSVVKDGACWGLIDTSGLHSSEAVLHDVSTAHTVFVRDFVQVHEELQGGRVGGAIVDVGHLHGDPFFNSISRMSGV

SEQ ID NO: 775747 - protein, 126 aa, Homo sapiens
DSGTRWSAVALGHSQRTIKSGVSWTRGPGLLSGPQSCLPNPGRRTFLDTISSYSTPAGAAAGGLGVVLPGSDTITTRLQTSPGHLCGRPQGHIPAGSQQTGASQDPVSGSEASTWFESLRGNVDPR

SEQ ID NO: 775748 - protein, 49 aa, Homo sapiens
AAVDWELTACKVPYAAFPSALSHLHEQMARPDCGGAEKMQRRGGQQSAR

SEQ ID NO: 775749 - protein, 69 aa, Homo sapiens
SSGNPLRSSFAVWKLCSFALCRNSCCCSLFGSTLPLGAVTLTAKVRSFTPEPARPRAHREERTTPDAPP

SEQ ID NO: 775750 - protein, 68 aa, Homo sapiens
NLLTGKTFLQPPSAGIGGADTQREPLERRFYQGEPGLRHSAHSTDTRSVGGQTNKRRDGPEVLPPVRP

SEQ ID NO: 775751 - protein, 34 aa, Homo sapiens
SVTIHLLFCQRFAEDQEWQELEEALRDTHSLLES

SEQ ID NO: 775752 - protein, 217 aa, Homo sapiens
MARGRGSLGVWEPAAGEGLRVRGPAPAVQSTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTP

SEQ ID NO: 775753 - protein, 1322 aa, Homo sapiens
MDSRGLPAWTSQSTEISTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEDLSSWLPSSPARSPSPAVPLRVVPTLSTTDMKTADKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKQENEDSSDATTPVPRVRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEAKPAATIRIVQGLGVMPPKAGQTITVATHAKQGASVASGSGTVHTSAVSLPSMNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 775754 - protein, 1324 aa, Homo sapiens
MHVFVQSTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEATLDLQEQFSFEDLSSWLPSSPARSPSPAVPLRVVPTLSTTDMKTADKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKQENEDSSDATTPVPRVRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEAKPAATIRIVQGLGVMPPKAGQTITVATHAKQGASVASGSGTVHTSAVSLPSMNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 775755 - protein, 1169 aa, Homo sapiens
NLETVVRRDSAASGQRNSQSQAVLQSVCEFGKEFLLEQEAKMVKNFKCVLGPAESQKSYITNVWKSGSVDPVTLKIFGTCSSQVSEGKLRNILLLTSDQKDVNWRIMIVNMVWFVFSDKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKQENEDSSDATTPVPRVRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEAKPAATIRIVQGLGVMPPKAGQTITVATHAKQGASVASGSGTVHTSAVSLPSMNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 775756 - protein, 137 aa, Homo sapiens
MDSRGLPAWTSQSTEISTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRGL

SEQ ID NO: 775757 - protein, 335 aa, Homo sapiens
MDSRGLPAWTSQSTEISTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEDLSSWLPSSPARSPSPAVPLRVVPTLSTTDMKTADKVELGDSDLKIMLKKHHEKRKHQPDHPDLLTGDLTLNDIMTRVNAGRKGSLAALYDKTVLKKKG

SEQ ID NO: 775758 - protein, 866 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 775759 - protein, 527 aa, Homo sapiens
TPVYFFSFPGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 775760 - protein, 808 aa, Homo sapiens
WKIDEYAMSDIRVMIRKYADRAYVIIMPHRDEYKEGVGYVFSQGVENECEASYTIAAYIYKSTAASTIDPATSKPPETSAGPSPEPSDVPGDVAVDVAVDVGVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 775761 - protein, 111 aa, Homo sapiens
AGSRKRAKWSRLELHRGKESLRTFARCVPSRGRALRDATRAMGAARSPPSAVPGPLLGLLLLLLGVLAPGGASLRLLDHRALVCSQPGLNCTVKNSKSSFSVLLLVAFLIK

SEQ ID NO: 775762 - protein, 138 aa, Homo sapiens
IQQRRNWRGPRLLAHPQQAQEECTCIRRVPREMRIRQAGWHPCQGGSSPGAHSEGATCGQAPSGEKIVVLGVRSLEEQISEGRGLMSFLFSGSTDCEHARMKVTTPCMSSGNSWPGRALFGCIHMHMCVPLLTPSLRV

SEQ ID NO: 775763 - protein, 356 aa, Homo sapiens
MTKSYSESGLMGEPQPQGPPSWTDECLSSQDEEHEADKKEDDLEAMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 775764 - protein, 80 aa, Homo sapiens
MGSCCVAQAGSYCFNALQQTLQGLRVDNPHKAGLKSKPKLLVPEEEISRSFTDYRGKQMSYRTYSFSNINYKTVTEVLLK

SEQ ID NO: 775765 - protein, 290 aa, Homo sapiens
SGGREAAAEARARPSLVPPGARLAATPTPAPVPSCPGAPRPRPGPRSAPPEGAALPAESAGPAMTDFKLGIVRLGRVAGKTKYTLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 775766 - protein, 80 aa, Homo sapiens
PCFELRPLSSARTQVSPTVPVPKELRACWGNSPRNTSLAPSVDPEEGAPRRSGPGPNSEGSSLQNQPLELRDSPTALRTP

SEQ ID NO: 775767 - protein, 38 aa, Homo sapiens
QAGCPQSGALGRARLDLRGYKKAAGPPHRRPGPDRTAT

SEQ ID NO: 775768 - protein, 115 aa, Homo sapiens
MTPLSPGRPSRGQHLDDETQFRRRSTERSPSFPGSPGSLLPLLLYSWQMTTGKAKRGPRTEEAVPRVCRGHKPQKFASLLPETGRTRNSLLKHVLNRVCNNMRLKSYCQTTKYNY

SEQ ID NO: 775769 - protein, 100 aa, Homo sapiens
STIVVSYMCILCAILQIQSREVQRKAFCTCFSHLCVIGLFYGTAIIMYVGPRYGNPKEQKKYLLLFHSLFNPMLNPLICSLRNSEVKNTLKRVLGVERAL

SEQ ID NO: 775770 - protein, 48 aa, Homo sapiens
MYKLTGLKAIMPARRFGGHFSGWTGASHLSKRIEPFQEEENPQRGVQI

SEQ ID NO: 775771 - protein, 155 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKV

SEQ ID NO: 775772 - protein, 116 aa, Homo sapiens
HDLGSLQPLPPTFKQFSASASQVARITGACHHARLIFVFLVEMGFHHVGQACLKLLTSGDPPASASQSAGITDVSHCAQWHWCFSCLQFQPLTPNPKVMCNPGMNKCKWCLLALGV

SEQ ID NO: 775773 - protein, 231 aa, Homo sapiens
LNFAAPSVSGQLLSVAAVFPMVCPGCLPCAILASPRQRLHPRSGLAPTPTALPPPTSASHLGVEGPASKTKESLTRTGQSGRDGGEGGAALAEPSLHSLPLERPSRLGPGRSGPAPPPAPVAGHQVRPYRGLRQGEGERGSLQTRPGRGGPGCPLLGSFHVLVPPELPFKPCPGPEVGNGFVFAPPGVPAARPLQLQQRQGHVPSAPARKTVALTLLCAPQLPPAAPPSGF

SEQ ID NO: 775774 - protein, 275 aa, Homo sapiens
PITSSTGFATCIAWQVHLARFPGIIDNHYPHVKLFQFLKLTSWILRNITRNTPLPEAVTVFTDASSNGRAAYTGPRERVLNTGAISAQRAELPAVMAVLEDFPEPVNIFSDSAYVVHVARNIETALIKFLPDDNLFLLFQKFQSVLRARSSPFYSTHIRAHTPLPGPLSAANARADTLVTPVFTDAENFHALTHVNAAGLRNKFPLTWKQAKTTVRHCPTCQVLILPPLSSGVNPRGLSQNALWQMDVTHYPPFGKLSFIHVTIDTFSHFIWATC

SEQ ID NO: 775775 - protein, 74 aa, Homo sapiens
VLPTPTPPAKAKAISSGPTKSPNLEPHLLPPVQEEPSSQSQDFPGGLSVWGLSKLRAFPAQIRSSGSLTNPPQP

SEQ ID NO: 775776 - protein, 48 aa, Homo sapiens
KRKMKLRAAGLAQGLQAANGRGQNGNQGPRNPRAPALSVPTDGIYSSA

SEQ ID NO: 775777 - protein, 61 aa, Homo sapiens
CPRSGAWRQRWGDLCCVFLVYTGWAVCYVYGLSSWGLQSQPQAWSSSKALAVQPPHFQAGQ

SEQ ID NO: 775778 - protein, 233 aa, Homo sapiens
MSSTVNNGAASMQSTPDAANGFPQPSSSSGTWPRAEEELRAAEPGLVKRAHREILDHERKRRVELKCMELQEMMEEQGYSEEEIRQKVGTFRQMLMEKEGVLTREDRPGGHIVAETPRLTEGAEPGLEYAPFDDDDGPVDCDCPASCYRGHRGYRTKHWSSSSASPPPKKKKKKKGGHRRSRKKRRLESECSCGSSSPLRKKKKSVKKHRRDRSDSGSRRKRRHRSRSYQVQK

SEQ ID NO: 775779 - protein, 177 aa, Homo sapiens
LLNKNGVNYIHSFAVPLSHRVAARRLAGLGQAPCAEKRGEEKSSRDLVVSVPVAGSVAETPRLTEGAEPGLEYAPFDDDDGPVDCDCPASCYRGHRGYRTKHWSSSSASPPPKKKKKKKGGHRRSRKKRRLESECSCGSSSPLRKKKKSVKKHRRDRSDSGSRRKRRHRSRSYQVQK

SEQ ID NO: 775780 - protein, 346 aa, Homo sapiens
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 775781 - protein, 326 aa, Homo sapiens
GASPLTDSRWRRQRRRPWTAGNGNPRSLTEHLPRLPAPDMAQEKMELDLELPPGTGGSPAEGGGSGGGGGLRRSNSAPLIHGLSDTSPVFQAEAPSARRNSTTFPSRHGLLLPASPVRMHSSRLHQIKQEEGMDLINRETVHEREVQTAMQISHSWEESFSLSDNDVEKSASPKRIDFIPVSPAPSPTRGIGKQCFSPSLQSFVSSNGLPPSPIPSPTTRFTTRRSQSPINCIRPSVLGPLKRKCEMETEYQPKRFFQGITNMLSSDVAQLSDPGVCVSSDTLDGNSSSAGSSCNSPAKVSTTTDSPVSPAQAASPFIPLDELSSK

SEQ ID NO: 775782 - protein, 326 aa, Homo sapiens; identical to SEQ ID NO: 775781

SEQ ID NO: 775783 - protein, 67 aa, Homo sapiens
ALKHVLTTPFPRFVRIEARIDHACFHGSSALKHVLTTPVPRFVRIEARIDHACFHGSSALKHVLTTP

SEQ ID NO: 775784 - protein, 220 aa, Homo sapiens
HELMLKENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 775785 - protein, 107 aa, Homo sapiens
PGVCSLNKYWLSTSYIPCRPVCAAERLTQWRDTLSAIKCWTNRSNRPHPVYFCTYILNSLNFDTRCDVSCLTEAAAKVQPLQVCWEGPWSTAPTGHHMQGLPEEKCR

SEQ ID NO: 775786 - protein, 38 aa, Homo sapiens
VQNEHRLSAALAPGGHVSEGEEEKPMVHGYRCGRTAGS

SEQ ID NO: 775787 - protein, 123 aa, Homo sapiens
QISLPPWHPLPRCWALQGRASLGHVPSLALEYAHSVLTETLLRAWSRFLPSPARHRHQWEVPGLHRPVGARGSPVASTKCTTAHGWLGAWEEPEPDPRPPGFLAAHCRVGAEPRAYTGCGLQP

SEQ ID NO: 775788 - protein, 74 aa, Homo sapiens
HLLSWGFARSGFFLLVPATQASPMSTLKPCNHVGLHAWPCGHWPVRVTARCAGLSLPLPLERHPHRCFLYPQVP

SEQ ID NO: 775789 - protein, 114 aa, Homo sapiens
SCQFFLFFSFKLNVSKIKLVYSPDLLISFMFITFFFVLVNDCHPSQNLGSSLIFLAPYMQPPNFSLHLLLTPIATASVWTIANLQLGSRAFSRSSELLALFPHPEPATGDPSKM

SEQ ID NO: 775790 - protein, 150 aa, Homo sapiens
YSTQFIWLPVATQSGCGLLALPLTTCSLAAADRERGESWWRPACPSQRWNGRYHLLPCSTDEASRQAGVPLDTGNTACLIPATQLGYRQYTKCVALWWGVPESTLGAPVAVHDLPSVRPPGEPATGVLPPWYETEWGSPDKMMDPGLHSW

SEQ ID NO: 775791 - protein, 105 aa, Homo sapiens
AEGHCSPVVGLRVPFSALMKTGSLPRCERWRGQAGVQLWPQGGVESAASQQYNLGWAQLFLETSRGGGLPNPAGGCWPRPAHQGSVSLQMAAFRPSPKTLGALFT

SEQ ID NO: 775792 - protein, 98 aa, Homo sapiens
LRAANSGASCPRRFKYRTEIAPGKGDMPTLTDKGRGRFALIIYENILKYVNLDAWNRELLDKYCVAYGVGIIGFFKPIENSPADCTAPRSYTSSLLSH

SEQ ID NO: 775793 - protein, 882 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 775794 - protein, 882 aa, Homo sapiens; identical to SEQ ID NO: 775793

SEQ ID NO: 775795 - protein, 882 aa, Homo sapiens; identical to SEQ ID NO: 775793

SEQ ID NO: 775796 - protein, 882 aa, Homo sapiens; identical to SEQ ID NO: 775793

SEQ ID NO: 775797 - protein, 882 aa, Homo sapiens; identical to SEQ ID NO: 775793

SEQ ID NO: 775798 - protein, 882 aa, Homo sapiens; identical to SEQ ID NO: 775793

SEQ ID NO: 775799 - protein, 882 aa, Homo sapiens; identical to SEQ ID NO: 775793

SEQ ID NO: 775800 - protein, 882 aa, Homo sapiens; identical to SEQ ID NO: 775793

SEQ ID NO: 775801 - protein, 882 aa, Homo sapiens; identical to SEQ ID NO: 775793

SEQ ID NO: 775802 - protein, 882 aa, Homo sapiens; identical to SEQ ID NO: 775793

SEQ ID NO: 775803 - protein, 825 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 775804 - protein, 674 aa, Homo sapiens
NSFSCVNVKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 775805 - protein, 854 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQLVRLPATALLSHLWPRALRDPLNLPNTKKLKYFNILFFFFLVPEFIPWVLGSHCVIYIYIYIYNVYIYIFYFFWLGSFLIQSYKMVVSPSLRGHPVLELEMRWQGGRLCPQWPGAEQTLGRGPPQCRGCSGATPGEQRW

SEQ ID NO: 775806 - protein, 556 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPVSAPQPMAAGEKGLLHSLSAADTGFLEPGKGGEA

SEQ ID NO: 775807 - protein, 900 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDVSGGHTTCSTCIRVRGPCMELRGILFPLPCTQHVHGLSISWTVFVRGGKWGLGHGGS

SEQ ID NO: 775808 - protein, 713 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTIRSSAEDPARSR

SEQ ID NO: 775809 - protein, 194 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKVHKKQGPRAVQSPLCSSVPEFSF

SEQ ID NO: 775810 - protein, 118 aa, Homo sapiens
PAPIQRLSHLHRFDPKKGFWCQLLEGGKTKCLGKSKGRKYPEMDLDVSGGHTTCSTCIRVRGPCMELRGILFPLPCTQHVHGLSISWTVFVRGGKWGLGHGGSDLISSNKCWLPSTKG

SEQ ID NO: 775811 - protein, 74 aa, Homo sapiens
EGAGSHIYKQAHSCCRGCCPCLPPKSKQVPIPFLPFQILVLDGKLLRTEPAKVMDMVQKFLGVTNTIDYHKTLA

SEQ ID NO: 775812 - protein, 103 aa, Homo sapiens
LAASRNYLHSCYLNRNHVLCLKTFSGPLVSEATSRLSNTAIHVIFHYLMILQILLDLKNPFGWVQWLIPVIQPTRETEAEALPESRRSRLAVSCVCATTLQPR

SEQ ID NO: 775813 - protein, 82 aa, Homo sapiens
QESSFPGAFLRGSALRGQAPPFPPLHHQGSGSACGSQVPPLLRKSQREAGEGEGSLGLPSSDLPSTHTAHSGLKGPTPQPAA

SEQ ID NO: 775814 - protein, 242 aa, Homo sapiens
MASLDDPGEVREGFLCPLCLKDLQSFYQLHSHYEEEHSGEDRDVKGQIKSLVQKAKKAKDRLLKREGDDRAESGNQGIMSLSAMEGLILTCGNPQELGAVRRHLSDFKKHRAARMTNYSGKSLQLTNQVEKLTASTDTNTESERFEHRNVGCWSTTTMSFANGDKSDPDRAHCALQAKSARSMGYKTYRSSHMLLSLYQPAQSPIGKRQQQTIRRKNRHDRHTNHDQAKGGQQTLTVTADTQ

SEQ ID NO: 775815 - protein, 817 aa, Homo sapiens
MGERKCWLSTSRRTRWVPEELQDKEFAAVLQDEPLQPLALEPLTEEEQAAAVVTAAFTKEASKKAMGPLDEAPGKSSAARAGMTARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKLFSAPHPGPMQKGPKEPIPEEQELDFQGLEEEEEPSEGLEEEGPEADDIRGIQLSPGVGSSAGPPGDLEDDEGLKHLQQGIQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPSSRSAEKWSSGRSGRKRNASVERRSAASSSRRSRSGGRRRKSCFGASTWGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 775816 - protein, 817 aa, Homo sapiens; identical to SEQ ID NO: 775815

SEQ ID NO: 775817 - protein, 577 aa, Homo sapiens
MGERKCWLSTSRRTRWVPEELQDKEFAAVLQDEPLQPLALEPLTEEEQAAAVVTAAFTKEASKKAMGPLDEAPGKSSAARAGMTARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKLFSAPHPGPMQKGPKEPIPEEQELDFQGLEEEEEPSEGLEEEGPEADDIRGIQLSPGVGSSAGPPGDLEDDEGLKHLQQGIQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRLLRRG

SEQ ID NO: 775818 - protein, 160 aa, Homo sapiens
ARLTLQGQLCHLQEHWPQCIGACRWLLCHGVGGSPSTAGPGRQLLFQGQVGGWLAACPTLGSLHPESRGRQSPSEECAPPYPETSEASFLRCQLFSQCPWPCPHPSLTGSPTPACRPRSPESQQASSVPPTPLTSRSPTSGSIFCPVVPASLPSPRGSDH

SEQ ID NO: 775819 - protein, 68 aa, Homo sapiens
MQQASWVSGQGTGSSLQHGGHDNHCRAGRAHQRPPGSRATKLDLKGNSTALLRPTPFDISRCLVALKM

SEQ ID NO: 775820 - protein, 290 aa, Homo sapiens
MGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 775821 - protein, 321 aa, Homo sapiens
AVEGLAVAVSMGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQNQPQSCNYLEIHPESPHYHTTVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 775822 - protein, 81 aa, Homo sapiens
NEMVFVQPRKRCPGPCLPASSLQHQLQRHRLGSGLCAPWLTPLPAVGEQWSNFGIGNFQMEGAVHAFIPCFSPLSGCPPWL

SEQ ID NO: 775823 - protein, 67 aa, Homo sapiens
TCWYSPGISRGVYGHCFKTGKEEDEARSRRVTKEISSSASPAEHFPALFFSSFEEKYSDPYVKLSCT

SEQ ID NO: 775824 - protein, 55 aa, Homo sapiens
MDNFIKGLKVEGATILPFLHGRTQQQGATMEAESSPHQTQMVLTSPWNSQTPELY

SEQ ID NO: 775825 - protein, 157 aa, Homo sapiens
MRHRSKLTERGRTTIRTEQHEQVETQSDDEEKKDRVPNQKGIRGTENSREKRRRERENEREKKKRRSKKKRRERQHTHRARISQTPTKRERSKTRRQRERQQKEGRSKETNKAYEAPQRKRKNEEQKQEEQGKEGRKRTKKKTQQTSTGKQKKERGK

SEQ ID NO: 775826 - protein, 582 aa, Homo sapiens
GARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVTDRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNGASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 775827 - protein, 165 aa, Homo sapiens
MGPSLPSQVPLSTMLFAEGAGARPFCRGLALAGSGPCALFATGASFLDCGRNQKACRWKRRSALCRGSVASWGPWRSFCSRYSPCSASPRPGTGDDVEAGTPPRSRMDTCVQCCGQPRVLAVPSRPPLFRTRRRLPAPRKQFFWFCLHSCLEEYCPLPTAHGPSS

SEQ ID NO: 775828 - protein, 233 aa, Homo sapiens
PRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTP

SEQ ID NO: 775829 - protein, 380 aa, Homo sapiens
RERVPPQLRASEEMAVRQAATAGTPGPRREEEAALLFERAHYRHDPRWLLPVTPRLCLACALELLPDPGVSLVRKKHMLSCFQDALVRHTSLVTQLVSQDQRVCIHFISVLFGLLCSMEDGSVTDLCIEVLIQITTQLKLEQTIRCLLDECHKELCNMPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGW

SEQ ID NO: 775830 - protein, 223 aa, Homo sapiens
MPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGW

SEQ ID NO: 775831 - protein, 149 aa, Homo sapiens
PTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLRLHGLTVEDEGNYTCEFATFPKGSVRGMTWLRVIGEQ

SEQ ID NO: 775832 - protein, 111 aa, Homo sapiens
EDPEIHMDCDFLMGTGSLPRWRTWWRWGIPAGGEELAQMGAHLREEPSPQPGVQPFLDSGWGWHLRAASSALRGQVPLPMYIQSFTHSSPSLFTCWTLGFICSSNKHLLGT

SEQ ID NO: 775833 - protein, 216 aa, Homo sapiens
MGILIWKRTPLNPGGELRPVTEASPAPQGLRVLGIHVSFHPFIHPFMHPCIHPAMHPPFIHPSINPSSHSFTHPSVRPSIHPSTHPPIHLPIHPFIHASIHPCVHPSIHLSIHPSIHPSSHSFIHPLMHLSIHPSILHSSFHPCIIHASILLVHPATHQLIHPSVHHPLIYPSIHPSFHQFTHLPSIHLSVHPFIYPSVHPSTYLFIHPSIHLSIH

SEQ ID NO: 775834 - protein, 51 aa, Homo sapiens
MGWVLRGRGLLRPRAWDRYLPQFLPSASPFPFWGRGQHLLSTYDLPGTGSS

SEQ ID NO: 775835 - protein, 613 aa, Homo sapiens
MGEAFYTVKLERLESCDTAGLSFQEVQKNTYDFECQWKDDEGNYKTVLMLQKENLPGRRAQRDRRAAGNRHIENQLGVSFQSHLPELQQFQREGKIYEYNQVEKSPNNRGKHYKCDECGKVFSQNSRLTSHKRIHTGEKPYQCNKCGKAFTVRSNLTIHQVIHTGEKPYKCNECGKVFSQPSNLAGHQRIHTGEKPYKCNECGKAFRAHSKLTTHQVIHTGEKPYKCKECGKCFTQNSHLASHRRIHTGEKPYKCNECGKAFSVRSSLTTHQTIHTGEKPYKCNECGKVFRHNSYLAKHRRIHTGEKPYKCNECGKAFSMHSNLTKHQIIHTGEKPFKCNECVKVFTQYSHLANHRRIHTGEKPYRCDECGKAFSVRSSLTTHQAIHTGEKPYKCNDCGKVFTQNSHLASHRGIHSGEKPYKCDECGKAFSQTSQLARHWRVHTGEKPYKCNECGKAFSVHSSLTIHQTIHTGQKPYKCNDCGKVFRHNSYLAIHQRIHTGEKPYKCNECGKAFSVHSNLATHQVIHTGEKPYKCNECGKVFTQNSHLANHRRIHTGEKPYRCNECGKAFSVRSTLTTHMAIHTGDKPYKCNQCGKVFTQNSNLAKHRRIHSG

SEQ ID NO: 775836 - protein, 613 aa, Homo sapiens; identical to SEQ ID NO: 775835

SEQ ID NO: 775837 - protein, 101 aa, Homo sapiens
GDRVSLCHSGIECSGMISAHCNLHLSDSSDFHASASQVARTTGMYHHSRLIFVVLVEMGFCHVSQAGLELLASSDLPSSASQSAGITGAKPHAQPCEVLLT

SEQ ID NO: 775838 - protein, 267 aa, Homo sapiens
PVGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQRCWWMQGAVPLFRYSVSRSQEIGFDKGWLASGPQWILAKNSPELAQNSKWMQELWFI

SEQ ID NO: 775839 - protein, 145 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRR

SEQ ID NO: 775840 - protein, 30 aa, Homo sapiens
MVSSVLCCVAVTAEVCEDGNHGLKAIETPD

SEQ ID NO: 775841 - protein, 85 aa, Homo sapiens
SALQQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 775842 - protein, 455 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 775843 - protein, 247 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENNTMA

SEQ ID NO: 775844 - protein, 187 aa, Homo sapiens
LGRQYATREFQRCAFSATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFIINGEQTGHNKNRWESVKESTLLTFTMTSVFKLG

SEQ ID NO: 775845 - protein, 193 aa, Homo sapiens
MRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNLLTGPPDISSPVNGELLETMAYSSIKQKRTTGLAMGPE

SEQ ID NO: 775846 - protein, 249 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSESILCPSA

SEQ ID NO: 775847 - protein, 124 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLLSPLSQCINNDCFFPVSYG

SEQ ID NO: 775848 - protein, 124 aa, Homo sapiens; identical to SEQ ID NO: 775847

SEQ ID NO: 775849 - protein, 229 aa, Homo sapiens
MSFLIDSSIMITSQIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSESILCPSA

SEQ ID NO: 775850 - protein, 226 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLRDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSESILCPSA

SEQ ID NO: 775851 - protein, 260 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSETSLSLCAKWITPWHKTIP

SEQ ID NO: 775852 - protein, 260 aa, Homo sapiens; identical to SEQ ID NO: 775851

SEQ ID NO: 775853 - protein, 391 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGKFN

SEQ ID NO: 775854 - protein, 432 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLRDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 775855 - protein, 133 aa, Homo sapiens
DAWVDPRVAKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSETSLSLCAKWITPWHKTIP

SEQ ID NO: 775856 - protein, 164 aa, Homo sapiens
TLEYPHVDTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGKFN

SEQ ID NO: 775857 - protein, 455 aa, Homo sapiens; identical to SEQ ID NO: 775842

SEQ ID NO: 775858 - protein, 455 aa, Homo sapiens; identical to SEQ ID NO: 775842

SEQ ID NO: 775859 - protein, 455 aa, Homo sapiens; identical to SEQ ID NO: 775842

SEQ ID NO: 775860 - protein, 513 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGLDWPTQGTAIKVSCLASGSQERTKLYQPPKLKSAEKMWGLKRSWKKSPKCLIHLHMFFFVHKDTIDPKNSVSILKASLLCWATLLNHPDQVALGVLLNSQEEAIVLPFLLGQFTFSGVEGGGHFL

SEQ ID NO: 775861 - protein, 391 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMNGAL

SEQ ID NO: 775862 - protein, 320 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVVTWASSL

SEQ ID NO: 775863 - protein, 249 aa, Homo sapiens; identical to SEQ ID NO: 775846

SEQ ID NO: 775864 - protein, 183 aa, Homo sapiens
ISPRMNRQLLGRCRCREILWATINIVFDRVGKTDPVTRGIEITVNYLGIQFDVKFWSQHISFILVGIIIVTSIRGLLITLTKFFYAISSSKSSNVIVLLLAQIMSHFWINSFDLQGMYFVSSVLLIRMSMPLEYRTIITEVLGELQFNFYHRWFDVIFLVSALSSILFLYLAHKQAPEKQMAP

SEQ ID NO: 775865 - protein, 335 aa, Homo sapiens
MYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 775866 - protein, 124 aa, Homo sapiens; identical to SEQ ID NO: 775847

SEQ ID NO: 775867 - protein, 42 aa, Homo sapiens
DPVSLAAGPRPQLSAVSRLEADFCSLLHKPSIVAASCTKASK

SEQ ID NO: 775868 - protein, 165 aa, Homo sapiens
CYRGGEAVCCRVQSSGPAGMESHLSPALLCGYPLCPSCQRICPKSLCRFLSLADEEQVVMGKEGRLRSMGCAESRSPFWTLCPPCGLPTGRETPHWGDQNKYLTIISHFTFSPQWLWAGRGCGLPATSSPVWGAAMVFKQASLPDPLPVIRCHRSPNSTMRGSFF

SEQ ID NO: 775869 - protein, 70 aa, Homo sapiens
AAFPRLPGCTTRGLHVPSDWHKVLSMPLLLAHLLCLWRVPHRATTSLRKASPTAQTSKGLLRVLQSLASH

SEQ ID NO: 775870 - protein, 586 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSSDRYSDASDDSFSEPRIAELEIS

SEQ ID NO: 775871 - protein, 586 aa, Homo sapiens; identical to SEQ ID NO: 775870

SEQ ID NO: 775872 - protein, 586 aa, Homo sapiens; identical to SEQ ID NO: 775870

SEQ ID NO: 775873 - protein, 489 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSSDRYSDASDDSFSEPRIAELEIS

SEQ ID NO: 775874 - protein, 586 aa, Homo sapiens; identical to SEQ ID NO: 775870

SEQ ID NO: 775875 - protein, 586 aa, Homo sapiens; identical to SEQ ID NO: 775870

SEQ ID NO: 775876 - protein, 577 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSRSLSPSLHVYIQMA

SEQ ID NO: 775877 - protein, 510 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILISLSLGLASVEHTECPSAFDLRDSLFIGLFCELPMLLEMNLDWDLD

SEQ ID NO: 775878 - protein, 383 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVTSTYQKYLSIKKEHKPSDKTNGEIDPDPSEILHRKRHTRGENRLTREERVQKKKTKAEARKRHAAKNNEERHTGRQRPAKTSSPGTTKTRNENGREEEIHGAEEKTGDERTENNMRKRKSTKTDGEISKGGKKESA

SEQ ID NO: 775879 - protein, 413 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMVIDMPEHNPGNLGGTMRLGIRRTVFKTENSILISLSLGLASVEHTECPSAFDLRDSLFIGLFCELPMLLEMNLDWDLD

SEQ ID NO: 775880 - protein, 123 aa, Homo sapiens
LSSLPVPSSPVPAVPPWQLRRSEFSQWWGQLTFAKENSQPLSPLLCSTLSLLPLHFLTALDSEKWQTEHGLSSSSHFIKLGGLDSPTQGKTADLDPKSKIGSVVLASSLWQSSSPCLPDFDAH

SEQ ID NO: 775881 - protein, 40 aa, Homo sapiens
HVHTRLREESASWKVLETSQTEKQEEMRINLKTEENGQDL

SEQ ID NO: 775882 - protein, 101 aa, Homo sapiens
MPNSRVQKELGIKRNFKGTALTWAESVCAIQLESQVLRQDVQMPQCRVLLINTCSPVLISNLTHPTLKAHLALVSRSSASVDSATADGKYSENKLDGYVSI

SEQ ID NO: 775883 - protein, 53 aa, Homo sapiens
HTHIYALSWDELHRAGWGLLPGKEAAGPWDAWSRFSRCQPCPLRTGQQQAQAQ

SEQ ID NO: 775884 - protein, 208 aa, Homo sapiens
FSPLPALPDGLQESQERPVVTCLKHEDFELAFLLLTKGADPRAISLTEGDTPLHAALHIFLEIKADIGFSFLSHLLDLFWSNPTEFDYLNPNVQDSNGNTLMHILFQKGMLKRVKKLLDLLVKFDINFNLKNKEGKDARHRIKKNDSLLLAWNKALMENRRRSRQDSAAHLGKLSKSTAPGHTSQLKSQGSFKSVPCGATARTLPEGS

SEQ ID NO: 775885 - protein, 34 aa, Homo sapiens
MVKQGNELKALQKCKVFRVIRCCETMETNSNAWR

SEQ ID NO: 775886 - protein, 69 aa, Homo sapiens
MVISLKGSQIYMLTLITDGMRSSECSTFDKAATSVLTTSMVTMEPGYLFLSSCLGNSLLLKYTEKLQEP

SEQ ID NO: 775887 - protein, 233 aa, Homo sapiens
PGKRCPNYTDPHSLTDVSIFLLLKLSEDPELQPVVAGLFLSMCLVTVLGNLLIILAVSPDSHLHTPMYFILSNLPLPDIGFTSTTVPKMIVDIQSHSRVISYAGCLTQMSLFAIFGGMEERHAPECDGLWPVCSHLSPSISFSNLEPMFLWLPRFVVFVLFCFVFLSLLDSQLHNLIALQMTGFKDVEFLISSGNLLNSPILHVVTPSPGTSTCISLLPYLVFFPSWGPFLLL

SEQ ID NO: 775888 - protein, 129 aa, Homo sapiens
MSAGSLQSSVFSVQQGGSPQTKGMEKMDRWIHPQLSFSAKSSGQEGKEQGSVLAGGWLQAWVLGSGWVGKEVQIGGLVGRDSEKDIGEEPGAAVWSEERGELVRSEPGWGSQGQDVAVGGAAGPLLSVD

SEQ ID NO: 775889 - protein, 410 aa, Homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 775890 - protein, 410 aa, Homo sapiens; identical to SEQ ID NO: 775889

SEQ ID NO: 775891 - protein, 47 aa, Homo sapiens
VILRQGTLSLNNSRTAWSFKPHIILTHLLQSLPGGMEGKAAWRSQMQ

SEQ ID NO: 775892 - protein, 126 aa, Homo sapiens
AAARDTPWRPSGPKTRGARFRPRRARPKFPWRRVGRCMALGPGGCRDVAASQGGAGARPRGREAARSRLSACFKPRGNCCTLDCTRSAVQASRFVNIRNFPLSSTASQNAVSLTTSEDPRARVQFW

SEQ ID NO: 775893 - protein, 126 aa, Homo sapiens; identical to SEQ ID NO: 775892

SEQ ID NO: 775894 - protein, 140 aa, Homo sapiens
PKAKKEAPAPSKAEDKAKALKAKKAMLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVLTGS

SEQ ID NO: 775895 - protein, 47 aa, Homo sapiens
MSPYQRQITTSNWSIQECKSPTPLTPGRTVMKNHLTPELLVESRPLL

SEQ ID NO: 775896 - protein, 70 aa, Homo sapiens
VAEAKESLHVSGIARFKPMLFKGQLYAEYKALLPSKQRLLKASHEIVGIHSLSPLPIRAFLYVKGRNALF

SEQ ID NO: 775897 - protein, 69 aa, Homo sapiens
AAFEDAPEGAASRRQSCCEKKTQEIWGSELCVCQRRSSSVGPRKAMHRPKLKKTLQRVWLCNPGLNAVA

SEQ ID NO: 775898 - protein, 69 aa, Homo sapiens; identical to SEQ ID NO: 775897

SEQ ID NO: 775899 - protein, 671 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 775900 - protein, 115 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRMLPASLVWSTGIPRPNRSAAATSESERDK

SEQ ID NO: 775901 - protein, 556 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAVAVTGGFLQTESVAIVLISR

SEQ ID NO: 775902 - protein, 136 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENR

SEQ ID NO: 775903 - protein, 525 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRISESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 775904 - protein, 671 aa, Homo sapiens; identical to SEQ ID NO: 775899

SEQ ID NO: 775905 - protein, 488 aa, Homo sapiens
DSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMVLQPPPSPQGFVQQPPPAQMPVYYYPSGQYPTSTTQQYRPMAPVQYNAQRSQQMPQAAQQAVAVTGGFLQTESVAIVLISR

SEQ ID NO: 775906 - protein, 659 aa, Homo sapiens
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 775907 - protein, 246 aa, Homo sapiens
MWKQKFRAKIRKRKVTTKINRHDKINGKRKTARKQKMFQRAQELRRRAEDYHKCKIPPSARKPLCNWVRMVAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPQTQEAEGGRGTTITQTQE

SEQ ID NO: 775908 - protein, 181 aa, Homo sapiens
MWKQKFRAKIRKRKVTTKINRHDKINGKRKTARKQKMFQRAQELRRRAEDYHKCKIPPSARKPLCNWVRMVAAEHRHSSGLPYWLYLTAETLKNRMGRQPPPPTQQHSITDNSLSLKTPPECLLTPLPPSVDDNIKECPLAPLPPSPLPPSVDDNLKECLFVPFHPLLFHPQWMIISRLLP

SEQ ID NO: 775909 - protein, 115 aa, Homo sapiens
LPAHLLKPGRCEPRARQPLPFSGVLRASNPRPWGLGPRRTGLEAGLRAFVPSCLPAVARPLLQPLVAGRVLGTWPFSHWAPPSWAKARTLVLGEDEMCSFEMLGFQRESCWRRRK

SEQ ID NO: 775910 - protein, 127 aa, Homo sapiens
MWVWVPLPCGSGDLEDMVNPGQGTCHPCMGSGTAGWSLLGRQPGVQLKSLECGSPSSRPVLRSSCRSFMSVFTGTCGGVSFDPSWRDGSMREPSTFILKMKRVLQLFGVCEVSPALYRCGNRGPGSL

SEQ ID NO: 775911 - protein, 74 aa, Homo sapiens
CSEKVCFASKEAEESVHKLPHAALVLLSHGQQHAIEPLLLLLSAHRAGSDPRPEVCALVLCSLHYFGSRRAQQL

SEQ ID NO: 775912 - protein, 243 aa, Homo sapiens
HLLFLFPTVLSPRPLLLSLSSPRAFPTTVFSPVFFPSHRFLPMSSHRLAAASVSRNLLPTFFSPPPIVFFPQPLILRHLLPLPTFSQQRLPAAFFSPRTLFSPLPLPTVFAPDRLLAHPLLALSNCLSPRSAPRVRPPVSLRLVCLCAAASPMSWAPELRPNSQQETQESRCQGHHGCRRPRPRRYLRTEQCWLRAKDSGARKTAGRGGGGDGEGGKDLGKWDGEKGGEEDSGEKVQGEDSVV

SEQ ID NO: 775913 - protein, 70 aa, Homo sapiens
PRPINQSKFQPGLSESRESQLLSFCAEGQGRGTKIEDQGCAASVPSWTTKFQLPAFFVGICSSQNGFSGT

SEQ ID NO: 775914 - protein, 290 aa, Homo sapiens
MHPINVRRDPSIPIYGLRQSILLNTRLQDCYVDSPALTNIWMARTCAKQNINAPAPATTSSWEVVRNPLIASSFSLVKLVLRRQLKNKCCPPPCKFGEGKLSKRLKHKDDSVMKATQQARKRNFISSKSKQPAGHRRPAGGIRESKESSKEKKLTVRQDLEDRYAEHVAATQALPQDSGTAAWKGRVLLPETQKRQQLSEDTLTIHGLPTEGYQALYHAVVEPMLWNPSGTPKRYSLELGKAIKQKLWEALCSQGAISEGAQRDRFPGRKQPGVHEEPVLKKWPKLKSKK

SEQ ID NO: 775915 - protein, 305 aa, Homo sapiens
VSERVYSSVGESSRCKHPINVRRDPSIPIYGLRQSILLNTRLQDCYVDSPALTNIWMARTCAKQNINAPAPATTSSWEVVRNPLIASSFSLVKLVLRRQLKNKCCPPPCKFGEGKLSKRLKHKDDSVMKATQQARKRNFISSKSKQPAGHRRPAGGIRESKESSKEKKLTVRQDLEDRYAEHVAATQALPQDSGTAAWKGRVLLPETQKRQQLSEDTLTIHGLPTEGYQALYHAVVEPMLWNPSGTPKRYSLELGKAIKQKLWEALCSQGAISEGAQRDRFPGRKQPGVHEEPVLKKWPKLKSKK

SEQ ID NO: 775916 - protein, 58 aa, Homo sapiens
GPKAQEGAVGTVHCTPLSQGRCSEAASSLLDCWEGKIHVALRRPTGRNATSDTFRVFM

SEQ ID NO: 775917 - protein, 114 aa, Homo sapiens
HQTRARLPLGRLQVGTDGCSPHHAALLQLTHPQLLPSSLRPCLLPALMPPLPATPVPTCPQLPTGADVAISVCPIIAPSLLGGRSHQCPSLHPENSLWEGLGQCLEEIRGPTHC

SEQ ID NO: 775918 - protein, 58 aa, Homo sapiens
MGSAVAASHVGVAQSHGTIEILPEGGSRWCLWVAPSSGGGVHSMATRGQQRLPRNTGV

SEQ ID NO: 775919 - protein, 123 aa, Homo sapiens
SVRGRCFGRPWVAAGTLTCSRPRPRFAESSGAGPQDLPALPLQSSVGETCVRFPRAGPLPSSALHPRHPGAVGPPPIRLLLLFLTQLGNSETTGASVRPLWPPRDHDPEVGQPRRAGRLTLAQ

SEQ ID NO: 775920 - protein, 79 aa, Homo sapiens
MANSPLLLCSIWALQIGGLRLSPLSQGMNEGEGDEQQGQQGVGSAGLGMGTPEPCCLLLHSFPAQELALTSSRQSCFSI

SEQ ID NO: 775921 - protein, 217 aa, Homo sapiens
RKSRRRWRRWERRGFWPILASKLGEIRMAVEELQSIIKRCQILEEQDFKEEDFGLFQLAGQRCIEEGHTDQLLEIIQNEKNQVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEE

SEQ ID NO: 775922 - protein, 493 aa, Homo sapiens
MICVCSVSLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITENWVLNQKHLQDFPGEDKENKHMKPHSLTLQSYELRFRKISKSSRPQIFRCITVTSGLFSAAFVALLFSVATQGQHHAGAVHDHEKTSKGGCCSVGACQLAVHPGETLAGIEPLSCFASVGAIDLQSHVEVNTNACAVAHCR

SEQ ID NO: 775923 - protein, 297 aa, Homo sapiens
MICVCSVSLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRIGMAGAKKFGAPPGPPGNPGPG

SEQ ID NO: 775924 - protein, 107 aa, Homo sapiens
MICVCSVSLRYLNASANSLESLPSACTGEESLSMLQLLYLTNNLLTDQCIPVLVGHLHLRILHLANNQLQTFPARLLSSMIILYMSMECGDFGSFKSLWGSSVFSVE

SEQ ID NO: 775925 - protein, 110 aa, Homo sapiens
MLLSGMPECNVWDGCGNKLKTIPTTIANCKRLHTLVAHSNNISIFPEILQLPQIQFVDLSCNDLTEILIPEALPATLQDLDLTGNTNLVLEHKTLDIFRATVNPQATVNP

SEQ ID NO: 775926 - protein, 736 aa, Homo sapiens
MICVCSVSLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 775927 - protein, 736 aa, Homo sapiens; identical to SEQ ID NO: 775926

SEQ ID NO: 775928 - protein, 72 aa, Homo sapiens
PTAARRLKAASVRSHFPDNIVRLLAPWSKTPMVRTPRPRETATPPYIRGERRIVYCWSSCRTCSSSVPSNGE

SEQ ID NO: 775929 - protein, 215 aa, Homo sapiens
MAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPNLSQNQHQPPENWAEALGVLLGAVVQIIFCMDAEIRSREEARAQEAAEFEEMAAWALAAGRKVKKEPGLAAEVGSALKAETPNNWN

SEQ ID NO: 775930 - protein, 199 aa, Homo sapiens
PSSRHALPTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIAPLSYCSHNTRIQDNYWLHHRNSYARYV

SEQ ID NO: 775931 - protein, 363 aa, Homo sapiens
PSSRHALPTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 775932 - protein, 669 aa, Homo sapiens
LRSVVAPDELERWFLSHIFGLEVSGTEGRQGPMCGRIVSAPQTCTDFGYLFGQWFGSDFFRIVANSPSFPGCLLSWIRNFFSPGAIGVEVSAMNPVNATALYISASRLVLNYDPGDPKAFTEINRLLPYFRQSLSCCVCGHLLQDPIAPTNSTCQHYVCKTCKGKKMMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 775933 - protein, 491 aa, Homo sapiens
MEYPYNYMSLVLTEPHEFENKADATDLYMNFGKKNNINLIVYGHALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 775934 - protein, 669 aa, Homo sapiens; identical to SEQ ID NO: 775932

SEQ ID NO: 775935 - protein, 127 aa, Homo sapiens
EIFSSLGFPDSFLSWFSSSQRPMYLEANKEAYISGLLTCRTLLMPHVSSGTPAAAHNTTLFCCWEVTWVRVPRSWSGVRRLPALSPLYLESSKSPPMMHFVDIRSHVPIQGEDLKETLCSAPCPGSP

SEQ ID NO: 775936 - protein, 76 aa, Homo sapiens
MEVSELRGQEGKVGPSPFSLLLSVLCPLSLGAGSTCLSTHSPQLKEVVLKSSKVVRADVCVVGIGELVCGQAGTKQ

SEQ ID NO: 775937 - protein, 394 aa, Homo sapiens
AGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 775938 - protein, 71 aa, Homo sapiens
PSGYIFITQRENGLIQLGMVVHACHSSDSEAAGSAVAGITGMCHHARLIFVFLVEMGFHHVGQAGLQLLTW

SEQ ID NO: 775939 - protein, 45 aa, Homo sapiens
TLRIPTLWNRGGTQPTYTTAVHLKGKQNQIKGGQPEYYPSEIIKY

SEQ ID NO: 775940 - protein, 102 aa, Homo sapiens
ASVSPGSPQGARLVILHLPEEESHLPVEQTAPDHPLQRVGVGITSASGYASVISARCDMTAWPGVFSHSSLPCLPPAALVPILADASSEREVHWTWRWKIYA

SEQ ID NO: 775941 - protein, 261 aa, Homo sapiens
MSRYTRPPNTSLFIRNVADATRPEDLRREFGRYGPIVDVYIPLDFYTRRPRGFAYVQFEDVRDAEDALYNLNRKWVCGRQIEIQFAQGDRKTPGQMKSKERHPCSPSDHRRSRSPSQRRTRSRSSSWGRNRRRSDSLKESRHRRFSYSQSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 775942 - protein, 211 aa, Homo sapiens
MQVTLSQFEDVRDAEDALYNLNRKWVCGRQIEIQFAQGDRKTPGQMKSKERHPCSPSDHRRSRSPSQRRTRSRSSSWGRNRRRSDSLKESRHRRFSYSQSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 775943 - protein, 166 aa, Homo sapiens
MKSKERHPCSPSDHRRSRSPSQRRTRSRSSSWGRNRRRSDSLKESRHRRFSYSQSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 775944 - protein, 107 aa, Homo sapiens
MFKQALTSMGLALFGGKSFQQSQVVTGEGRCSINRYRDSKALAERNGPIQAPGKAVAGLRGFNASGQTDDSGRCRGHMLRPPWDGVGSSTQGEDTYHPRYALSGHSA

SEQ ID NO: 775945 - protein, 109 aa, Homo sapiens
MKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPF

SEQ ID NO: 775946 - protein, 710 aa, Homo sapiens
MNVKNNGAAAVPYSLFLLHYVSASLERHLTARRFMVEMTNCFFTTSSPCFLTSWNHPCSCNISNLPVSLTTNHPERIWHSLQLLILSSPEGLLNRWSVHLAFSYSEQSFMIFSFLLSLSPQLPEPRIRQGPPLKRPQRRELGSGPGSPRFDSLLGQDFLNIIAWPWCQGGCGAEGGACAAHFPVEVSCPFPFPYQAQAILGAALLSEGVSPEPLRHSPHSYWVLLTIIPSSAASFCDLWTQVGLCLSCSRRAGKGDSLNCSGHMLLVNILKFDLLQFFRGIESKSHFMEKSNKELVLFLLGDTNNQTGDTSEFKWLVKKKKKNTSENSKSTLMLVLYNRRCSKRFACSNSLNPHNYFMKRRFSNLVTEAMNGQDSGSKTGSPDHDDPSLGLMEIITKSPPLGFSAVGNGVLPAEYCCDLSFRPLCAETAVVCVSAVLLKLVHTFLDFWLSQSAQILNFQTNLFLFGPQPGFVTSAATAVETVDKQGQAAQRENVAVGSLEGLPAHLEGQRPRNPRAIDAQAVIVLRLVGRGVCFSFLLPFSSSLSLALFLSSSFPSSFLPPFLSPLKNKDEVLVKIVHRREASSLKKLFDNIVSHCSLLNKRPKGLRWRGIEVKSGFGSGLNTQTRPALGWVGSAWHEETSKDSVSLREPCWEIFSALDFEVKIKSLAPLAGISERLMGFYCLTVPFPDERPPCMGFVAALCLSLPNDPI

SEQ ID NO: 775947 - protein, 81 aa, Homo sapiens
YLFFTKSEMDENQIQMAGDDVDLPEDLRKMVDEDQEEEEDKDSILGQIQNLQNMDLDTIKEKAQATFTEIKQTAEQKCSVM

SEQ ID NO: 775948 - protein, 104 aa, Homo sapiens
TLCPQGSLLGESMASERMGQVRWGWLLRAGRTRAELEASGPEDPPSDLGQLWARLGPKRPDHPAWQHTRAQARPEGAAPGGPMVHGSLCWPCGHTAQVPGPDDG

SEQ ID NO: 775949 - protein, 196 aa, Homo sapiens
MIRMKDSLICLDCAMESSRNSSMLTLRLSFFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWLPSRAH

SEQ ID NO: 775950 - protein, 279 aa, Homo sapiens
ITVPRGADEQRRSVPFQMLLLLEKMQDSRQKAVWPLELAYCLQKYNVPLFVQHDAAQLYLKLWNLIKDQIADVHLVERLQALYMIRMKDSLICLDCAMESSRNSSMLTLRLSFFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWLPSRAH

SEQ ID NO: 775951 - protein, 160 aa, Homo sapiens
MPLTRQQGRLLVTLSPVRTDRQADRRTDKQMLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQTRESRYVAQASLELLASSNPPT

SEQ ID NO: 775952 - protein, 126 aa, Homo sapiens
MSPGAMRRSLPSTSSTSSTKRLKSVEDEMDSPGEEPFYTGQGAPQEVAVSQVDGMNGARNAISNHTEEVGEVWFQQPLPFTDLLPGNGVHTASPTCHYRTQSKSTCNTIDSSFPDITHYPAAWALL

SEQ ID NO: 775953 - protein, 37 aa, Homo sapiens
YTEADRFSLNSLLRRHCRSSPPGEVEFQESLPGSPSP

SEQ ID NO: 775954 - protein, 38 aa, Homo sapiens
TALHLACASDHVKVVTLLVSRKCQIDICDKENRTPLIQ

SEQ ID NO: 775955 - protein, 219 aa, Homo sapiens
MAASLLAVLLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMGRGWLCCPGGTCGTKNRTDSSLVWTTL

SEQ ID NO: 775956 - protein, 228 aa, Homo sapiens
MAASLLAVLLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGTYDERPTQGPACFDNARASLEQTSWDITSSLDGKSCFVPEDLLKERTISLCDSMDSDTVVSHGASITIDPGTSLIGSE

SEQ ID NO: 775957 - protein, 116 aa, Homo sapiens
MAASLLAVLLLLLLERGMFSSPSPPPALLEKVFQYIDLHQDEFVQTLKEWVAIESDSVQPVPRFRQELFRMMAVAADTLQRLGARVASVDMGPQQGNFMDEERPTTKALSWLGSML

SEQ ID NO: 775958 - protein, 112 aa, Homo sapiens
MDPLSWMEPKTSCVIFALSPSLKYCFWLLLLFSMASSEPMPWYFLSCIPSEKKHSPGASMVAASREPIITVEAPRARALTTCPMVWMPPSAMMGTPKFWVCLATLYTAVPWG

SEQ ID NO: 775959 - protein, 39 aa, Homo sapiens
MARDKNTCIRTSKDEHQDTVNTEAITTSACSRTTTSAVS

SEQ ID NO: 775960 - protein, 136 aa, Homo sapiens
MCENRRHPTGHLVNFNPRATEGAMTRPRPSLQEAVRAAAWTPGSPRVLSPQLVPCASFITNTTQLAPSSHGWLRSWFPGQGRGHDKPPFGAQAPQTAWGHTSWPMCLHCVHRSFLFCSIQQALQRGPQHSTWGGLG

SEQ ID NO: 775961 - protein, 33 aa, Homo sapiens
PHPLAPSARVLRGTRSTTFGGAAEPSAPGTPPP

SEQ ID NO: 775962 - protein, 193 aa, Homo sapiens
MGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 775963 - protein, 75 aa, Homo sapiens
AAAYYYYCSNSSFYRCTGTCLSANLNGKYYHQKYRGVRNGIFWGTWPGVSEAHPGGYKSSFKEAKMMIRPKHFKP

SEQ ID NO: 775964 - protein, 452 aa, Homo sapiens
PCALPAGVSSTVKMKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 775965 - protein, 452 aa, Homo sapiens; identical to SEQ ID NO: 775964

SEQ ID NO: 775966 - protein, 452 aa, Homo sapiens; identical to SEQ ID NO: 775964

SEQ ID NO: 775967 - protein, 309 aa, Homo sapiens
PCALPAGVSSTVKMKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSEDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 775968 - protein, 290 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHVCVNWSRYSMCEGSKRH

SEQ ID NO: 775969 - protein, 191 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKLNVAQGMADYFPDNEEFQTVLLEVDAGECGNPQAFAGEQ

SEQ ID NO: 775970 - protein, 885 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 775971 - protein, 885 aa, Homo sapiens; identical to SEQ ID NO: 775970

SEQ ID NO: 775972 - protein, 713 aa, Homo sapiens
MQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 775973 - protein, 829 aa, Homo sapiens
EDPRDKQEKLFKEHVFIYLRMFATDSGFEILPCNRYSSEQNGAKIVATKEWKRNDKIELLVACIAELSEIEEDMLLRHGENDFSVMYSTRKNCAQLWLAPAYSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 775974 - protein, 471 aa, Homo sapiens
MSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 775975 - protein, 774 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSS

SEQ ID NO: 775976 - protein, 402 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNAKNPEEKGRCFP

SEQ ID NO: 775977 - protein, 713 aa, Homo sapiens; identical to SEQ ID NO: 775972

SEQ ID NO: 775978 - protein, 393 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNASK

SEQ ID NO: 775979 - protein, 282 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHEAVFPRCWR

SEQ ID NO: 775980 - protein, 173 aa, Homo sapiens
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARQPKTVPSSI

SEQ ID NO: 775981 - protein, 86 aa, Homo sapiens
VISSTHLSNGHFRNIKGVFRGPLSKNGNKTLDYAEKENTIAKALEDLKANFYCELCDKQYYKHQEFDNHINSYDHAHKQVRKRCEK

SEQ ID NO: 775982 - protein, 82 aa, Homo sapiens
VISSTHLSNGHFRNIKGVFRGPLSKNGNKTLDYAEKENTIAKALEDLKANFYCELCDKQYYKHQEFDNHINSYDHAHKQVGF

SEQ ID NO: 775983 - protein, 48 aa, Homo sapiens
HQKTTVNQMDMDSVLNGPQQLWPTLGSQRGESGSAGEAEKSWMQSPRA

SEQ ID NO: 775984 - protein, 110 aa, Homo sapiens
IPTCYHAGLKRCCSIWDTPQSEADSSPREDLQRQEADLRLPRTWGAGGKYWGAMAKGCNVSFGGDEKRFKIVLGRAQWLTPVIPELWRVEVGGSQGQEFETSLSNTVKPR

SEQ ID NO: 775985 - protein, 64 aa, Homo sapiens
MRYPQPGKRGWSGRRASEELGPCVGPLSGSQGAWDLRSPFRGLFTNRNRNIKPAQTPGLSNFMS

SEQ ID NO: 775986 - protein, 137 aa, Homo sapiens [sequence omitted]

SEQ ID NO: 775987 - protein, 75 aa, Homo sapiens
AFYGCLYCGCVPVTVRPPHPQNLGTTLPTVKMIVEVSKSACVLTTQAVTRLLRSKEAAAAVDIRTWPTILDTGAC

SEQ ID NO: 775988 - protein, 111 aa, Homo sapiens
VARGYHVGQRHPRALLWPKDVQRVRFLGAWEMWRISDVTPDLLDLNLLFNTISRWFKKHWASLETSQCLSRDFQAVVLVKDGRFLLSSLPSQLFSQPAVVFRGPMCVGPCG

SEQ ID NO: 775989 - protein, 192 aa, Homo sapiens
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 775990 - protein, 192 aa, Homo sapiens; identical to SEQ ID NO: 775989

SEQ ID NO: 775991 - protein, 156 aa, Homo sapiens
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARG

SEQ ID NO: 775992 - protein, 141 aa, Homo sapiens
GEPDTGTAAFWSLPPSGCLPFALSGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 775993 - protein, 192 aa, Homo sapiens; identical to SEQ ID NO: 775989

SEQ ID NO: 775994 - protein, 192 aa, Homo sapiens; identical to SEQ ID NO: 775989

SEQ ID NO: 775995 - protein, 134 aa, Homo sapiens
TTTKFAAAGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 775996 - protein, 203 aa, Homo sapiens
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKVGIYVCLYLFTSLNIGAFTSATVNRQSS

SEQ ID NO: 775997 - protein, 161 aa, Homo sapiens
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGMLFWL

SEQ ID NO: 775998 - protein, 81 aa, Homo sapiens
FSLRRWQPSVPPRAGGPLGPRRPCYGACGRRGGSSPRVRLGYLRGPEEDEQAPALLPGFKLRHDRVFCTHDMERLDRAHRQ

SEQ ID NO: 775999 - protein, 200 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESG

SEQ ID NO: 776000 - protein, 61 aa, Homo sapiens
MRTSTLRGLLTPLSLAVCSPVCSGTGWRKRHISVTIISISASTISSLPHMVALALRTQNSS

SEQ ID NO: 776001 - protein, 75 aa, Homo sapiens
PCLALCGVACLPCHPPLPLSLSPEPTGRWSWKAMCIVACAGARVLLLPLEQAPPFPGHPPSRVGLDTSSLPPEGP

SEQ ID NO: 776002 - protein, 211 aa, Homo sapiens
LTLLFLGLGLHLILSFLLRADPPRVQRGDCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRR

SEQ ID NO: 776003 - protein, 361 aa, Homo sapiens
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQALVCTLYFPFYCGLIPPEFRGERYIDGALSNNLPFADCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRR

SEQ ID NO: 776004 - protein, 158 aa, Homo sapiens
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQVWGGGCPGLGWWAGSI

SEQ ID NO: 776005 - protein, 85 aa, Homo sapiens
MAEGGFRKLMIIAEGEANKSFFTWAAARRSAEQKGEKTLIKRPIRSVRTHSLSQEQQHGTNCPHDSITSHQVPPMTHGDYGNYIS

SEQ ID NO: 776006 - protein, 46 aa, Homo sapiens
LRLRVEPGQKRNSSWNKESEKTRLLDRTSDEASPQTDEPAAPSKLN

SEQ ID NO: 776007 - protein, 178 aa, Homo sapiens
MGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGSEMLQELLGFSPLKPLCRVWAALRSNLRTVACHRCGVHVLQSALLQLPRLLGSAAEEEEEEEEDGKDGPTET

SEQ ID NO: 776008 - protein, 335 aa, Homo sapiens
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTGEKPYKCHDCGKAFSQSSNLFRHRKRHIRKKVP

SEQ ID NO: 776009 - protein, 142 aa, Homo sapiens
GWVTCLLSVHLLKCSPLSFSWHLIAAPTAVQDRHSTVQTAMDGGFRYHPGHETPPEPCPALLSASTLSPRVHLISVGTDSKSMPMTTHANGKSVQRPSREKQGRSQTPPPPHFMTVSASAPMLQIRTNWKDKCSELSQETWE

SEQ ID NO: 776010 - protein, 116 aa, Homo sapiens
SLNRFSSPFLKPVSERQAPGYKDVVKRPMDLTSLKRNLSKGRIRTMAQFLRDLMLMFQNAVMYNDSDHHVYHMAVEMRREVLEQIQVLNIWLDKRKGSSSLEGEPANPVDDGKPVF

SEQ ID NO: 776011 - protein, 74 aa, Homo sapiens
ENAFSPGSLVHPPVISGLPYVPRVDFRRGQGWVVLSGEPEAAGGWRRGEPNEKLPRQPPPHTQPAPRDTRGVAV

SEQ ID NO: 776012 - protein, 41 aa, Homo sapiens
GVRMEEKALGPGSEAQDSEQTQVVGRGDVWKTHRYRSLNTN

SEQ ID NO: 776013 - protein, 355 aa, Homo sapiens
LERSPWAAGPDRTAPGSPAGEFCQISGQMGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSEMKLQDGKRLLGPQWLDYDCDRAVIEDWVFRVPHVAIFLSVVICKGFLVLCSSLDLTTLVPERQVDQGRGFESILDVLSVMYINAQLPREQRHRWRLLFSSELHGHSFSQLCGHITHRGPCVAVLEDHDKHVFGGFASCSWEVKPQFQGKTWCPEP

SEQ ID NO: 776014 - protein, 362 aa, Homo sapiens
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKKSFGERILEENESQGWVLSDLSCPEWFIPSQICFQFTEDLVGSVVHVLSHRQELRGWTGKEAPGPNPRVQVLAAQLLSEMKLQDGKRLLGPQWLDYDCDRAVIEDWVFRVPHVAIFLSVVICKGFLVLCSSLDLTTLVPERQVDQGRGFESILDVLSVMYINAQLPREQRHRWRLLFSSELHGHSFSQLCGHITHRGPCVAVLEDHDKHVFGGFASCSWEVKPQFQGKTWCPEP

SEQ ID NO: 776015 - protein, 138 aa, Homo sapiens
KNVLRKHDQRREMSPEAFRIVQGEIRRVWTKGKAKRWREAGACDVSGRKNDVGKEGGRRVQSGHQSPDLEDGSMGKMAFLEKGRDGALRVGAALEVSSEQVGKESSRWMDGCECNLERKFHFSQTGKYKTTQQKSPIT

SEQ ID NO: 776016 - protein, 68 aa, Homo sapiens
RLKSAFKDSDYVYPSLEQLEKNVVEAFKTMHKCVKQFKDMPGREPSRPIPSSLPLPPASHAFLSYPAA

SEQ ID NO: 776017 - protein, 46 aa, Homo sapiens
TGTASRMQYHAPLSSMMGRTGMPSDFTPAWDTFSQEKSKEAAPQVR

SEQ ID NO: 776018 - protein, 115 aa, Homo sapiens
CRFQLEMETPGAKAALEPLRLPWPLCSPRSPESSHFQHLTPSWGLPSWKPKGQAQGVMGDIPPAHPEPGLWRPHGWRVWWNHLETLECCEDILPGPSCRDRARLTPGWGLFVRIV

SEQ ID NO: 776019 - protein, 68 aa, Homo sapiens
PGPHLTCILCPPSPPGGRRKPTPMVPASGIISLALRSTAFPRTLDVSICSLCFSFPPKRSPWDAMKES

SEQ ID NO: 776020 - protein, 74 aa, Homo sapiens
RSETPPFASLAFTAARDVILVEFRVQSPWVLAVPARAVSGGSKTICVLLFHNLMKTQVLDFFPAPYFRTILKAL

SEQ ID NO: 776021 - protein, 108 aa, Homo sapiens
MSGTGRRKAFQPIHRSPACRIECAVVLLPGRGNTECGAGLRRERYLLELTRIPRPASPGCCQQLPMQPQRRSGSLCPSRPRVLQGRGLVPEVSLCPSSTFRSCRNMSR

SEQ ID NO: 776022 - protein, 96 aa, Homo sapiens
ASPGRAGCTPSTYLAGRASPGTKGALGSKPSPRPREDAALRKEGRCPQGTLPGHPGGGSISTSDEKHGPPGYLGGSEGKCQDGENTPAPHRVSPEE

SEQ ID NO: 776023 - protein, 405 aa, Homo sapiens
KVSRGQYSLGTAAALPGQQKNTELMDLRQQNQALEKQLEKMRKFLDEQAIDREHERDVFQQEIQKLEQQLKVVPRFQPISEHQTREVEQLANHLKEKHRQMQGAYCSLTEPASQGAYTKTRNESNISSNTVEFSSKEELGSKAAYRCDVQAYLFNNGQQDRPNERKRACSKLKPSNSPLASHNIARAELKACHKTSNGKHTRHAQQLSKSQSAHSHEHARNVGTHSKGTATESANQSKHTAQIDKLTRKKRTANLSRPYRTKARNQGQSQLKRHGHGNTGAKQNDQGTTWANVTRKPVNEPTEPSSTEPTKAAQEGEKLGITNPKPAKTKRRNTATKEKTGTPGHRTSLRDTQTENRVPTTNTQGEPGTNKQDQLDKGHPRHPQTGNLPGSKQTTKPRATHTDTR

SEQ ID NO: 776024 - protein, 364 aa, Homo sapiens
RDSTRRLAWPGCSGCCWNPRGGRKRRRQAAVTQAATRASGTPSPRDGTMTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 776025 - protein, 364 aa, Homo sapiens; identical to SEQ ID NO: 776024

SEQ ID NO: 776026 - protein, 274 aa, Homo sapiens
MVYTSHYKSPGRRPLKTHPTVTYWRVNEGSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 776027 - protein, 155 aa, Homo sapiens [sequence omitted]

SEQ ID NO: 776028 - protein, 93 aa, Homo sapiens
CIDSARGRYAATSRRAADCITNAAQSVSSCLSHPGQALTLCKKGGRGHSWAGGVGGQDGCPSLPIFSWLWDQLALDEPYDLQSNACKNASNAD

SEQ ID NO: 776029 - protein, 364 aa, Homo sapiens; identical to SEQ ID NO: 776024

SEQ ID NO: 776030 - protein, 155 aa, Homo sapiens [sequence omitted]

SEQ ID NO: 776031 - protein, 241 aa, Homo sapiens
SPFVAMEASQQVEINSILTAQRKINSKHRSPFVTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776032 - protein, 134 aa, Homo sapiens
MPKPPRKPPRFPIPGPPGPPGPPAAPASSAIWCKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776033 - protein, 153 aa, Homo sapiens
VNKPPIWGYVHVQAGSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGAMEMRRYSAVVTYAPDITNE

SEQ ID NO: 776034 - protein, 658 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776035 - protein, 539 aa, Homo sapiens
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776036 - protein, 658 aa, Homo sapiens; identical to SEQ ID NO: 776034

SEQ ID NO: 776037 - protein, 658 aa, Homo sapiens; identical to SEQ ID NO: 776034

SEQ ID NO: 776038 - protein, 658 aa, Homo sapiens; identical to SEQ ID NO: 776034

SEQ ID NO: 776039 - protein, 658 aa, Homo sapiens; identical to SEQ ID NO: 776034

SEQ ID NO: 776040 - protein, 627 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGRRESFYYQLQ

SEQ ID NO: 776041 - protein, 658 aa, Homo sapiens; identical to SEQ ID NO: 776034

SEQ ID NO: 776042 - protein, 673 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGYTCTEEKIGRHYQNWRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776043 - protein, 658 aa, Homo sapiens; identical to SEQ ID NO: 776034

SEQ ID NO: 776044 - protein, 660 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTIQLPVKTFLWPTLAVIPT

SEQ ID NO: 776045 - protein, 422 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQGEVCWNLEETMPLLPLKMQTSA

SEQ ID NO: 776046 - protein, 621 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGYNFVYFENLYKSDLCDLQDQTVASIKRVPS

SEQ ID NO: 776047 - protein, 528 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVRDALRSIV

SEQ ID NO: 776048 - protein, 503 aa, Homo sapiens
AFLHCPGLNTAPDTHYCSKQCFIEYNGKVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776049 - protein, 594 aa, Homo sapiens
YFNSSQGLGLIPTSPGSVMCDSLSLRTADVVHCMANRPRERSSWTIGSKLGDELSLLSRHPSSRNRDPQYVVGVKSRLGAYTQHVNKTDVWRCYYEMGKDLVGKCLEGGWFIVAEPYFARCIETKGAQIRKSLDEVMVVDYEETVEKGKKEAWNNLGQSIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776050 - protein, 631 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776051 - protein, 430 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGAMEMRRYSAVVTYAPDITNE

SEQ ID NO: 776052 - protein, 279 aa, Homo sapiens [sequence omitted]

SEQ ID NO: 776053 - protein, 292 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSEM

SEQ ID NO: 776054 - protein, 226 aa, Homo sapiens [sequence omitted]

SEQ ID NO: 776055 - protein, 610 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGYNFVYFENLYKSDLCGEWT

SEQ ID NO: 776056 - protein, 591 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGPREPPLVMYHQYKYPVLN

SEQ ID NO: 776057 - protein, 482 aa, Homo sapiens
MYGPGFESAEETIACYQRANSKSRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776058 - protein, 423 aa, Homo sapiens
MENLGRYSCSKTRRNSKTDWRCLAGEDPSTRKLDVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776059 - protein, 640 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADILLVVLYFLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 776060 - protein, 393 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVIFCKVIF

SEQ ID NO: 776061 - protein, 268 aa, Homo sapiens
MCIYHDDQVITRILQFQNPCYSLLYFSANILLKRIPSWNCGSRSLSPDGSSPLLPVALPLFQAGFSRRLLRKTRGRRGGGGVVPSGRGRVCPMGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQE

SEQ ID NO: 776062 - protein, 117 aa, Homo sapiens
PNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPT

SEQ ID NO: 776063 - protein, 182 aa, Homo sapiens
PKHLDLPPRARSAGFVQGLRGAASGRGRPGPSTAPTNRLASRDGDPGPARSRPGGLRPRAWPSARPERVGGAELCGGAFRAPGLCRAGFPLRGEAAGRAAVRGSNKGPRPQKRPPRVLCFCVEQTLHTCVFSEGFPCAERLQSGVAPGETRSRCPRLTQGPQPDSGTRGARAGPPGDRGKHR

SEQ ID NO: 776064 - protein, 92 aa, Homo sapiens
LTPMCMLHLHGSSPAHSAELQPIEHPSNGSNTPEICSGSHRPLASKSFYFLFPISGSGQGQMPTHSFSLLFSALPSSHWLCVLSLYPVLIPP

SEQ ID NO: 776065 - protein, 262 aa, Homo sapiens
CDVCGKDFNQKRYLAHHRRCHTGEKPYMCNKCGKVFNKKAYLARHYRRHTGEKPYKCNECGKTFSDKSALLVHKTIHTGEKPYKCNECGKVFNQQSNLARHHRVHTGEKPYQCKECDKVFSRKSYLERHRRIHTGEKPYKCKVCDKAFRHDSHLAQHIVIHTREKPYKCNECGKTFGENSALLVHKTIHTGEKPYKCNECGKVFNQQSNLARHHRLHTGEKPYKCKECDKVFSRKSHLERHRRIHTGEKPYKCKVCDKAFRR

SEQ ID NO: 776066 - protein, 74 aa, Homo sapiens
NGDRRIDRREGVLAERKRVLTVLRRGLAGPRDEASQTSASLGESQLQRLQRSQQIPVPVSLLLPVRGCGTHHEQ

SEQ ID NO: 776067 - protein, 50 aa, Homo sapiens
ANLPGTPGAERRRPDTAPKTRPHLIFKLAPSSQLHQQLVPQPPIHLRRAQ

SEQ ID NO: 776068 - protein, 48 aa, Homo sapiens
MANSGCLLLSNSGSMLPHSVPCPPAFLYLQQSDQDATAPPEAMAQPYP

SEQ ID NO: 776069 - protein, 123 aa, Homo sapiens
CLELTDSCQPYRSAFYILEQQCVGLAVDMDEIEKYQEVEEDQDPSCPRLSRELLAEKEPEVLQDPLDRCYSTPSGYLELPDLGQPYSSAVYSLEEQYLGLALDVDRIKKDQEEEEDQGPPCPR

SEQ ID NO: 776070 - protein, 184 aa, Homo sapiens
WRVECQNFVIVENSGKPPAGQGHEDPPRSTAPRGAQGPRSRPPLGADTSAPDLSRTSSRCRRRRRRGCVSRLGSEGGRRPARHRPTWPRRAEPQVPEECSLPAGVLPAQHGPEPRPRGLQPAAHQLPGERGRGSTAAQHPRRNTESREAQAPPRRAQLHSAASFLLHTYIGVGAEDHLLLADFL

SEQ ID NO: 776071 - protein, 50 aa, Homo sapiens
MGARLLLLSSSPRFRRNARSPLESYQPNTDLSRDHAGCSLQHISYPENAD

SEQ ID NO: 776072 - protein, 590 aa, Homo sapiens
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 776073 - protein, 590 aa, Homo sapiens; identical to SEQ ID NO: 776072

SEQ ID NO: 776074 - protein, 590 aa, Homo sapiens; identical to SEQ ID NO: 776072

SEQ ID NO: 776075 - protein, 605 aa, Homo sapiens
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEVSRGPTPTPDKHPCTLGPFIHATNALHVRESQSQAS

SEQ ID NO: 776076 - protein, 381 aa, Homo sapiens
GARGCGGGGGGSGGSGYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 776077 - protein, 130 aa, Homo sapiens
MDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 776078 - protein, 89 aa, Homo sapiens
MASSFPPIWPRVVGGLEVKVRRCPSETTQEACVFSLFLPAGPSCESPCGAAAAGALLQASVPSRGEAYKLPGTCSSSGGGRAGSLVSSP

SEQ ID NO: 776079 - protein, 108 aa, Homo sapiens
EGEGRASLGGDAFKKSSTAAVETVLFGFIYTEWFFSEMLSCLKEEMPPQELTRRLATVITHVDEIMQQEVRPLMAVEIIEQLHRQFAILSGGRGEDGAPIITVPEFSG

SEQ ID NO: 776080 - protein, 142 aa, Homo sapiens
MEKVWIPVEMGFEPRSVQAQGLCFDCIRPPSDYMPAPLLEFVSPRQANSPFYRLLILKECTPHTDFFQFSRLVLTSPFLLLVVTVITVSYLQFFKDSCSWAAFGDQQATESHHRKEGLAVTIGQMKILILREPPPQLDPART

SEQ ID NO: 776081 - protein, 82 aa, Homo sapiens
MPRPQGKEAEELGLLQEPGVQPSLAPWAGLTVALQAGVGGETHRHLPHLHGLPSPGLPASRSAVMGAILLAASRRKQSTALM

SEQ ID NO: 776082 - protein, 39 aa, Homo sapiens
MALSPPPLLSTPTTAIVICVPMASLLHGGTSSGLPVATV

SEQ ID NO: 776083 - protein, 638 aa, Homo sapiens
MGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 776084 - protein, 103 aa, Homo sapiens
MGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSG

SEQ ID NO: 776085 - protein, 104 aa, Homo sapiens
GAGAGAIPGVSKGQGGGQILVLWLPEDANGNLEASDLDSTIPWLGTSTDLWKFPGGPQPFWYHHHLTYDRPASPTVCCPLFLHKRLWSLFPTWCSEAPSINSST

SEQ ID NO: 776086 - protein, 67 aa, Homo sapiens
MLEDDLLLTSSTLPGLPPVGENIKCQECGPAPEPGPACRGGWHSWDAPCPVAGPRVSKCEAVPTGTT

SEQ ID NO: 776087 - protein, 79 aa, Homo sapiens
MSGEKEHQNNRGVNKNLNDPNERPEHERKILQTEKPNTDQRNPRTKHPRDTENARPKSEVETNNERGTKRKIPEPQRED

SEQ ID NO: 776088 - protein, 49 aa, Homo sapiens
MNTQSVSSSILLTVYSQALTPYQRGKVNLPQNTIWFNYRCILDIFNQRL

SEQ ID NO: 776089 - protein, 67 aa, Homo sapiens
MPPRTVVYFPVRGRCADLSMLLADQGQSWKEEVVTVEMWQEGSLKASCLYGQLPNVPVTETSPLYQV

SEQ ID NO: 776090 - protein, 40 aa, Homo sapiens
THRASVIESESEILHHEKQYEPFYSSFVALSTHYITTVCS

SEQ ID NO: 776091 - protein, 75 aa, Homo sapiens
EPVRLGLGQESWACDISQGGLWSRDPDSISATSAAGLSGFKSHKVTVHESQNVPGLWIPKNKASTVMMVTSRSCS

SEQ ID NO: 776092 - protein, 59 aa, Homo sapiens
MRQDTDDIDSLNAVSRKWYIDWWDSEAQRIPLSSSHGKHDPRQLDAFGSASEEAHQMRP

SEQ ID NO: 776093 - protein, 41 aa, Homo sapiens
MVGWGLDSGAEVALEHSCCLLTVAGCGSDSLEQKWRLRTSR

SEQ ID NO: 776094 - protein, 595 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776095 - protein, 400 aa, Homo sapiens
DHWPGPALGTWQAGEAMWPGLQESISPSVLHSEGTCLCLGWGQQQGPPPPLQSHRCVWEAFLPVLDVGPWQGPKFGGGEDLPLRWLKDTEQERGLLQAPSPPWGGADRSPALLQRRQAGSSATWAWRLRANFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776096 - protein, 470 aa, Homo sapiens
RPLAWPCSGDVAGRRGHVARAAGKHLTLSPALRGHVSLSGLGPAARPPSPTPITQMCLGSFFARFGCWALAGSKVWWRRGPAPEVAQGHRAGEGAPAGPQPAMGWCRQEPRSAAAQAGWILCHMGVEAQGVSPGRGRKVRAWECSSGGDLIQSARHCTFVLELKGSPGRLSREEHWVGFAFGWEVVPGARESTGFPHLKGNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776097 - protein, 618 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776098 - protein, 733 aa, Homo sapiens
RPLAWPCSGDVAGRRGHVARAAGKHLTLSPALRGHVSLSGLGPAARPPSPTPITQMCLGSFFARFGCWALAGSKVWWRRGPAPEVAQGHRAGEGAPAGPQPAMGWCRQEPRSAAAQAGWILCHMGVEAQGVSPGRGRKVRAWECSSGGDLIQSARHCTFVLELKGSPGRLSREEHWVGFAFGWEVVPGARESTGFPHLKGNFRKHLRMVGSRRVKAQTFAERRERSFSRSWSDPTPMKADTSHDSRDSRCPAQARPPSPEPPLDPRPLLGVPCQGRWAAAFALLNLGLPVCEMGTPSASPIAKAGLTTAAAVLAGGACRAVPTATRKRPSGAGGCGARPHSLPGARRTWLELMPARAFHRPRTRVSLPTSGRCPVVSTGLSCRAGGDLCMVLPLAWRTLRDGAFGPCGPWGHGQDRRCCRACCPGDPLASQGSDLQSSHCTLDEAFEDLDWDTEKGLEAVACDTEGFVPPKVMVEAQPGQCSSTPRAGLRPNPSPASSAWDHAAFSSCLGEGVSQGYTLGLPGSQKVASWGLPQPLGFWMGLGPLSSSLSPQLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776099 - protein, 618 aa, Homo sapiens; identical to SEQ ID NO: 776097

SEQ ID NO: 776100 - protein, 645 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYVSPAPGLPPTDALLLAPPWASAGTPGPQGAVALLALTQPCCGLVACVCPQDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776101 - protein, 618 aa, Homo sapiens; identical to SEQ ID NO: 776097

SEQ ID NO: 776102 - protein, 162 aa, Homo sapiens
AAKSTGERNGSLPATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776103 - protein, 138 aa, Homo sapiens
NIGLGTRLGGADLENADFLPGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776104 - protein, 254 aa, Homo sapiens
AGTGLGCSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHPSSTVRSVEWGACPLPLGDPPLSTSFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776105 - protein, 618 aa, Homo sapiens; identical to SEQ ID NO: 776097

SEQ ID NO: 776106 - protein, 618 aa, Homo sapiens; identical to SEQ ID NO: 776097

SEQ ID NO: 776107 - protein, 344 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQASRCSGATRRGSAGNGRMIPRL

SEQ ID NO: 776108 - protein, 149 aa, Homo sapiens
MGEGWWRPLAWPCSGDVAGRRGHVARAAGKHLTLSPALRGHVSLSGLGPAARPPSPTPITQMCLGSFFARFGCWALAGSKVWWRRGPAPEVAQGHRAGEGAPAGPQPAMGWCRQEPRSAAAQAGWILCHMGVEAQGVSPGRGRKVRAWE

SEQ ID NO: 776109 - protein, 618 aa, Homo sapiens; identical to SEQ ID NO: 776097

SEQ ID NO: 776110 - protein, 674 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISNFRKHLRMVGSRRVKAQTFAERRERSFSRSWSDPTPMKADTSHDSRDSSDLQSSHCTLDEAFEDLDWDTEKGLEAVACDTEGFVPPKVMVRPSPGSAPLHPEQDSAPTRVQPALPGTTQPSPAAWGRVSHRAIPLGCLAAKKVASWGLPQPLGFWMGLGPLSSSLSPQLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776111 - protein, 316 aa, Homo sapiens
MSLKDPPEALNGQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYVSPAPGLPPTDALLRPHPGPAPAPQVPRVLWRCWLCRSLDVAFVACVCPQDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 776112 - protein, 618 aa, Homo sapiens; identical to SEQ ID NO: 776097

SEQ ID NO: 776113 - protein, 618 aa, Homo sapiens; identical to SEQ ID NO: 776097

SEQ ID NO: 776114 - protein, 618 aa, Homo sapiens; identical to SEQ ID NO: 776097

SEQ ID NO: 776115 - protein, 267 aa, Homo sapiens
SLIKLIPLPPRVRAALSRERRHARSAGCGHAGTGPDPEPDPEPKPEPEPERDPEPEPERDPRCGAATPAEAAGAGRALRPGGCAAASTMGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLLCLSVF

SEQ ID NO: 776116 - protein, 108 aa, Homo sapiens
PAEGPAVPRKEPTQPLGSTRERPWVGPCSMAGARQVSRPLAAHRTESPSPALPQTINSGLSCSQEASPGPLAPAAQPGGGWIPVPVTLSGAAPHPQVCTWHSHCPRIP

SEQ ID NO: 776117 - protein, 432 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGGP

SEQ ID NO: 776118 - protein, 122 aa, Homo sapiens
PSNSVGSCREVTHFSWRRARTGQIQVHRAGQGEGGVGSQLMQCGGSGFVTEEGRMFKQFNKLTEDKADVQSIIGLQRFFETRMNEAFGDTKFSAVLVEPPPMSLPGAGLSSQELSGGPGDGP

SEQ ID NO: 776119 - protein, 393 aa, Homo sapiens [sequence omitted]

SEQ ID NO: 776120 - protein, 393 aa, Homo sapiens [sequence omitted]

SEQ ID NO: 776121 - protein, 393 aa, Homo sapiens [sequence omitted]

SEQ ID NO: 776122 - protein, 393 aa, Homo sapiens [sequence omitted]

SEQ ID NO: 776123 - protein, 432 aa, Homo sapiens; identical to SEQ ID NO: 776117

SEQ ID NO: 776124 - protein, 432 aa, Homo sapiens; identical to SEQ ID NO: 776117

SEQ ID NO: 776125 - protein, 432 aa, Homo sapiens; identical to SEQ ID NO: 776117

SEQ ID NO: 776126 - protein, 393 aa, Homo sapiens [sequence omitted]

SEQ ID NO: 776127 - protein, 432 aa, Homo sapiens; identical to SEQ ID NO: 776117

SEQ ID NO: 776128 - protein, 432 aa, Homo sapiens; identical to SEQ ID NO: 776117

SEQ ID NO: 776129 - protein, 393 aa, Homo sapiens [sequence omitted]

SEQ ID NO: 776130 - protein, 432 aa, Homo sapiens; identical to SEQ ID NO: 776117

SEQ ID NO: 776131 - protein, 432 aa, Homo sapiens; identical to SEQ ID NO: 776117

SEQ ID NO: 776132 - protein, 432 aa, Homo sapiens; identical to SEQ ID NO: 776117

SEQ ID NO: 776133 - protein, 863 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQQQGALQGQPGSAHGAGRQHGPMTKDPRSNTGGQQFVQLQPHWSIWRRDNNHSPYLTILTEVDLLPDMPPETSSMHCRHPVAATWRDDSIQKGPSMPGTKEVAEGLYGERKDGKLQSLSNKLQAEPMRAQWNHSKAAPRDPRSKAGTLAAASPWRCRKAMASETGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776134 - protein, 432 aa, Homo sapiens; identical to SEQ ID NO: 776117

SEQ ID NO: 776135 - protein, 432 aa, Homo sapiens; identical to SEQ ID NO: 776117

SEQ ID NO: 776136 - protein, 432 aa, Homo sapiens; identical to SEQ ID NO: 776117

SEQ ID NO: 776137 - protein, 338 aa, Homo sapiens
ASANRLAHTIRQVSGWRTQYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776138 - protein, 337 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQQDPEAPGAHSALCLLGSGE

SEQ ID NO: 776139 - protein, 432 aa, Homo sapiens; identical to SEQ ID NO: 776117

SEQ ID NO: 776140 - protein, 432 aa, Homo sapiens; identical to SEQ ID NO: 776117

SEQ ID NO: 776141 - protein, 403 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGALHLSRDHLLTQSHSL

SEQ ID NO: 776142 - protein, 359 aa, Homo sapiens
GTWTSQLTASHPSSPEQAGTLAAASPWRCRKAMASETGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGCVSCVIFCLLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776143 - protein, 111 aa, Homo sapiens [sequence omitted]

SEQ ID NO: 776144 - protein, 432 aa, Homo sapiens; identical to SEQ ID NO: 776117

SEQ ID NO: 776145 - protein, 180 aa, Homo sapiens
SAWMVQTAHGRGCHPPPSGQGAEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776146 - protein, 117 aa, Homo sapiens
RPTRPDPRVREFAQDVGRMFKQFNKLTEVSQWNGEAVGRGRCEGKNYGPIHPLHSCLAQDKADVQSIIGLQRFFETRMNEAFGDTKFSAVLVEPPPMSLPGAGLSSQELSGGPGDGP

SEQ ID NO: 776147 - protein, 397 aa, Homo sapiens
MGARTGHGKYFLGPAYERGFVLAAEMGHLTKVGEKKARGGEGLVRCGIMVGGPPSRGMVGAITWVGTCNSLPHPCFSEVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGGP

SEQ ID NO: 776148 - protein, 393 aa, Homo sapiens [sequence omitted]

SEQ ID NO: 776149 - protein, 432 aa, Homo sapiens; identical to SEQ ID NO: 776117

SEQ ID NO: 776150 - protein, 393 aa, Homo sapiens [sequence omitted]

SEQ ID NO: 776151 - protein, 393 aa, Homo sapiens [sequence omitted]

SEQ ID NO: 776152 - protein, 432 aa, Homo sapiens; identical to SEQ ID NO: 776117

SEQ ID NO: 776153 - protein, 393 aa, Homo sapiens [sequence omitted]

SEQ ID NO: 776154 - protein, 432 aa, Homo sapiens; identical to SEQ ID NO: 776117

SEQ ID NO: 776155 - protein, 432 aa, Homo sapiens; identical to SEQ ID NO: 776117

SEQ ID NO: 776156 - protein, 432 aa, Homo sapiens; identical to SEQ ID NO: 776117

SEQ ID NO: 776157 - protein, 432 aa, Homo sapiens; identical to SEQ ID NO: 776117

SEQ ID NO: 776158 - protein, 432 aa, Homo sapiens; identical to SEQ ID NO: 776117

SEQ ID NO: 776159 - protein, 354 aa, Homo sapiens
MRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776160 - protein, 230 aa, Homo sapiens
ISHSARRVCIVRGGNLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 776161 - protein, 432 aa, Homo sapiens; identical to SEQ ID NO: 776117

SEQ ID NO: 776162 - protein, 432 aa, Homo sapiens; identical to SEQ ID NO: 776117

SEQ ID NO: 776163 - protein, 212 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTATPAQSSDHHDKVHHDT

SEQ ID NO: 776164 - protein, 34 aa, Homo sapiens
VLGEDPDLAIFQWHLFHHEFLRQSDGATLFQNNH

SEQ ID NO: 776165 - protein, 46 aa, Homo sapiens
ENWSGFQMSATVRRAAKERQLRVLCGSCIAFPWVSTRSLGAHHLPW

SEQ ID NO: 776166 - protein, 107 aa, Homo sapiens
MEPPSPPGPWPCAELCPIKFLDVKKKPKKHGRAQCGADNKGRQGPGHGVPDRVRSRETAGPKEGKRSTGTGRPEEKTRGGRHLTKARHAGHHHRARTTITRNGVHAR

SEQ ID NO: 776167 - protein, 451 aa, Homo sapiens
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKRSLGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776168 - protein, 558 aa, Homo sapiens
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKRFAPLRQFVHLAVHAENFRSEIVSVREMRDIWSWVPERFALCQPLLLFSSLQHGYSLARFYFQCEGHEPTLLLIKTMQKEVCGAYLSTDWSERNKFGGKLGFFGTGECFVFRLQPEVQRYEWVVIKHPELTKPPPLMAAEPTAPLSHSASSDPADRLSPFLAARHFNLPSKTESMFMAGGSDCLIVGGGGGQALYIDGDLNRGRTSHCDTFNNQPLCSENFLIAAVEAWGFQDPDTQ

SEQ ID NO: 776169 - protein, 218 aa, Homo sapiens
PCAGSPSSRSVSPLLLPFAVPAPPAFSRSPPLFVSVAPAQLARPVSASVSSLFLLLSAVFLLSCCPSPVLPAPLCPLPSSPFVVCVSSCSLFFRFGLAFGLFLSSLVLFSRVCRFGCWFVLFVCLFRDYGFCWCCFLWSLWYKTVCSLSLIFCFGVTFFFLFGDFCCACFYPFLYALQYVLYIPPMDAFYCSWCVNVVPIFSLCTVFEVFVTTRGCTR

SEQ ID NO: 776170 - protein, 113 aa, Homo sapiens
IRHEGALGTIGRAKSGTGIAAMSVMRPEQIMKSIIPVVMAGIIAIYGLVVAVLIANSLNDDISLYKSFLQLGAAQAHAQAGRIAFAAARPQTFVPGPSSPPGMRRPDSGPLML

SEQ ID NO: 776171 - protein, 286 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776172 - protein, 286 aa, Homo sapiens; identical to SEQ ID NO: 776171

SEQ ID NO: 776173 - protein, 201 aa, Homo sapiens
DTPFTGAIGSMALLQKLLCIVGAGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776174 - protein, 286 aa, Homo sapiens; identical to SEQ ID NO: 776171

SEQ ID NO: 776175 - protein, 155 aa, Homo sapiens
MSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776176 - protein, 177 aa, Homo sapiens
SHPRTLLDTAPRRATAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776177 - protein, 171 aa, Homo sapiens
RLVRHGVVDAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776178 - protein, 360 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELAPSPPADMSESKSGPEYASFFAVMGASAAMVFSGERGRQGGTRGRGRAQSLMPAARRGPVCDVTLTVIPELTGAPRASCDSGRGSAPRGLRGASRGSGAQGMRAWTGSLGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776179 - protein, 112 aa, Homo sapiens
MSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776180 - protein, 112 aa, Homo sapiens; identical to SEQ ID NO: 776179

SEQ ID NO: 776181 - protein, 173 aa, Homo sapiens
MRIRIMPTNSRGCWAVPARQRPPRCRLQSRLPGRSGHAQAGAQLEEALVEADVVIQGVGDEDCHHQAVDGDDASHDHWDNGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776182 - protein, 173 aa, Homo sapiens; identical to SEQ ID NO: 776181

SEQ ID NO: 776183 - protein, 173 aa, Homo sapiens; identical to SEQ ID NO: 776181

SEQ ID NO: 776184 - protein, 286 aa, Homo sapiens; identical to SEQ ID NO: 776171

SEQ ID NO: 776185 - protein, 117 aa, Homo sapiens
IANSLNDDIQAVDGDDASHDHWDNGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 776186 - protein, 218 aa, Homo sapiens; identical to SEQ ID NO: 776169

SEQ ID NO: 776187 - protein, 275 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIVALILSTK

SEQ ID NO: 776188 - protein, 286 aa, Homo sapiens; identical to SEQ ID NO: 776171

SEQ ID NO: 776189 - protein, 263 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAAQAHAQAGRIAFAAARPQPSCPARPRPRACADLIRGR

SEQ ID NO: 776190 - protein, 210 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANP

SEQ ID NO: 776191 - protein, 107 aa, Homo sapiens; identical to SEQ ID NO: 776166

SEQ ID NO: 776192 - protein, 201 aa, Homo sapiens
RRETGPTLRRSRGRRRPETPAEAEAGRGRAPGPGRWAGGTARGRSTGRPGVPGTRLPHGAKWYGSQGRGPGHVTRPRPPFCSAVLVFRAQRLTGRIAFAAARPQTFVPGPSSPPPPPPPRPAELCAPRPHTAARTMSGVQGGGTTEYAFSHVSTDHWCCSSETARWSFQPAPWAAWLTGYMPKMRGTPGKRGDVLSNACRE

SEQ ID NO: 776193 - protein, 173 aa, Homo sapiens
RRETGPTLRRSRGRRRPETPAEAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIVALILSTK

SEQ ID NO: 776194 - protein, 65 aa, Homo sapiens
MRSVLVPIVCFPGLAPIVQALPTTYGSSCRLTTYTGGQEDRAVIKLEMSSGPTLAGTVVIHPNVF

SEQ ID NO: 776195 - protein, 138 aa, Homo sapiens
MASTRPGLNWPRLVFRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANP

SEQ ID NO: 776196 - protein, 96 aa, Homo sapiens
MRIRIMPTNSRGCWAVPARQRPPRCRLQSRLPGRSGHAQAGAQLEEALVEADVVIQGVGDEDCHHQAVDGDDASHDHWDNGLHDLLRPHDRGRHAG

SEQ ID NO: 776197 - protein, 142 aa, Homo sapiens
MVLEMEAGVLLRCGRGGEWSRSAQPKCLLSLQGPGIQQPKRLLSLQGPHIQQPKRLLSLQGPHIQQPKRLFSLQGPHIQQPKRLLSIQGPHIQQPKRLLSLQGPHIQQPKRLLSLQGPHIQQPKRLLSLQGPHIQQPKRLLS

SEQ ID NO: 776198 - protein, 40 aa, Homo sapiens
ASETCHPSMAPLEPGTDSLSAMLRKQGAMTGPIPADSPGE

SEQ ID NO: 776199 - protein, 103 aa, Homo sapiens
WRSLRPLKSPFTGQSPDHRAALSQQQLVGVFTRPGLLLQQVHESLASYPMQHPWWERMCLVLTLRQSSPVVQRATKCLEQPQLMEPSPQRDTTSRQAVWCLPW

SEQ ID NO: 776200 - protein, 87 aa, Homo sapiens
WHGDLPTVPCPGSVPPGGPCMVAQLALALLYACAQQAPPVLCRHLQNPASPFSPAQPPQVASSSSCKPPGREPRSQCHVCSVVQPHS

SEQ ID NO: 776201 - protein, 113 aa, Homo sapiens
AASGFTAPPRAQPLWGLRGSRRQDACPAEWQGISSPFQGKVGPGLWALNMKAGGRGTRGPREARRAHGRARHPWLRSVGLGRLAPAWKLAGWCLRETVLSLVRRQTLRIYCRC

SEQ ID NO: 776202 - protein, 165 aa, Homo sapiens
HQASTSPRVNRPRQGPELIVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 776203 - protein, 289 aa, Homo sapiens
AGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSQKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHICKPSC

SEQ ID NO: 776204 - protein, 118 aa, Homo sapiens
VIWSVCFVFQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 776205 - protein, 337 aa, Homo sapiens
AGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSQKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVNGLWPRDRGSST

SEQ ID NO: 776206 - protein, 346 aa, Homo sapiens
AGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSQKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 776207 - protein, 346 aa, Homo sapiens; identical to SEQ ID NO: 776206

SEQ ID NO: 776208 - protein, 347 aa, Homo sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKERYMKELEQYQKTEAYKVFSRKTQDRQKGKSHRQDAARQATHDHEKETEVKERSVFDIPIFTEEFLNHSKAREAELRQLRKSNMEFEERNAALQKHVESMRTAVEKLEVDVIQERSRNTVLQQHLETLRQVLTSSFASMPLPGSGETPTVDTIDSYMNRLHSIILANPQDNENFIATVREVVNRLDR

SEQ ID NO: 776209 - protein, 347 aa, Homo sapiens; identical to SEQ ID NO: 776208

SEQ ID NO: 776210 - protein, 347 aa, Homo sapiens; identical to SEQ ID NO: 776208

SEQ ID NO: 776211 - protein, 347 aa, Homo sapiens; identical to SEQ ID NO: 776208

SEQ ID NO: 776212 - protein, 347 aa, Homo sapiens; identical to SEQ ID NO: 776208

SEQ ID NO: 776213 - protein, 347 aa, Homo sapiens; identical to SEQ ID NO: 776208

SEQ ID NO: 776214 - protein, 347 aa, Homo sapiens; identical to SEQ ID NO: 776208

SEQ ID NO: 776215 - protein, 348 aa, Homo sapiens [sequence omitted]

SEQ ID NO: 776216 - protein, 204 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPALPLYCCSLSVQGQL

SEQ ID NO: 776217 - protein, 195 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGFSLPI

SEQ ID NO: 776218 - protein, 53 aa, Homo sapiens
MPGWRLLTQVGAQVLGRLGDGLGAALGPGNRVTTNSLNVSLIRRNVGSEEKVG

SEQ ID NO: 776219 - protein, 348 aa, Homo sapiens [sequence omitted]

SEQ ID NO: 776220 - protein, 348 aa, Homo sapiens [sequence omitted]

SEQ ID NO: 776221 - protein, 348 aa, Homo sapiens [sequence omitted]

SEQ ID NO: 776222 - protein, 348 aa, Homo sapiens [sequence omitted]

SEQ ID NO: 776223 - protein, 368 aa, Homo sapiens
KCLEAPSRVGMRASAGDRSGGHCENFPTATASTWRWRGDSLKAERQGARKSTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 776224 - protein, 322 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKCGITPKATIYVMVVLAKWSAGQDLRRFSPENYIPILVGQGAHIFRRFRGL

SEQ ID NO: 776225 - protein, 268 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDFGGVWPGPNCLEIGNFSGRFG

SEQ ID NO: 776226 - protein, 130 aa, Homo sapiens [sequence omitted]

SEQ ID NO: 776227 - protein, 204 aa, Homo sapiens; identical to SEQ ID NO: 776216

SEQ ID NO: 776228 - protein, 70 aa, Homo sapiens
RERERERERERVDHKNGLVKVKDSKLPAYKDLGKNLPFPTYFPDGDEEELPEDLYDENVCQPGAPSITFA

SEQ ID NO: 776229 - protein, 70 aa, Homo sapiens; identical to SEQ ID NO: 776228

SEQ ID NO: 776230 - protein, 348 aa, Homo sapiens [sequence omitted]

SEQ ID NO: 776231 - protein, 348 aa, Homo sapiens [sequence omitted]

SEQ ID NO: 776232 - protein, 348 aa, Homo sapiens [sequence omitted]

SEQ ID NO: 776233 - protein, 242 aa, Homo sapiens
MPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 776234 - protein, 330 aa, Homo sapiens
MPGWRLLTQVGAQVLGRLGDGLGAALGPGNRTHIWLFVRGLHGKSGTWWDEHLSEASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 776235 - protein, 315 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 776236 - protein, 195 aa, Homo sapiens; identical to SEQ ID NO: 776217

SEQ ID NO: 776237 - protein, 163 aa, Homo sapiens
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRVRMYFHS

SEQ ID NO: 776238 - protein, 480 aa, Homo sapiens
MSDGFDRAPGAGRGRSRGLGRGGGGPEGGGFPNGAGPAERARHQPPQPKAPGFLQPPPLRQPRTTPPPGAQCEVPASPQRPSRPGALAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776239 - protein, 400 aa, Homo sapiens
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776240 - protein, 400 aa, Homo sapiens; identical to SEQ ID NO: 776239

SEQ ID NO: 776241 - protein, 367 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776242 - protein, 465 aa, Homo sapiens
MSDGFDRAPGAGRGRSRGLGRGGGGPEGGGFPNGAGPAERARHQPPQPKAPGFLQPPPLRQPRTTPPPGAQCEVPASPQRPSRPGALAPEQTRPLRAPPSSQDMVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776243 - protein, 400 aa, Homo sapiens; identical to SEQ ID NO: 776239

SEQ ID NO: 776244 - protein, 400 aa, Homo sapiens; identical to SEQ ID NO: 776239

SEQ ID NO: 776245 - protein, 400 aa, Homo sapiens; identical to SEQ ID NO: 776239

SEQ ID NO: 776246 - protein, 140 aa, Homo sapiens [sequence omitted]

SEQ ID NO: 776247 - protein, 74 aa, Homo sapiens
PPRPFPPALRDPDYQEKYQELLEREDFFPDYEENGTDLSGAGDPYLDDIDDEMDPEIEEAYEKFCLESERKRKQ

SEQ ID NO: 776248 - protein, 480 aa, Homo sapiens; identical to SEQ ID NO: 776238

SEQ ID NO: 776249 - protein, 400 aa, Homo sapiens; identical to SEQ ID NO: 776239

SEQ ID NO: 776250 - protein, 367 aa, Homo sapiens; identical to SEQ ID NO: 776241

SEQ ID NO: 776251 - protein, 403 aa, Homo sapiens
MKKRAELHCKAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776252 - protein, 263 aa, Homo sapiens [sequence omitted]

SEQ ID NO: 776253 - protein, 284 aa, Homo sapiens
RVVTDSLLPRLTATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 776254 - protein, 140 aa, Homo sapiens [sequence omitted]

SEQ ID NO: 776255 - protein, 347 aa, Homo sapiens
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAAIRYDMWGSSRS

SEQ ID NO: 776256 - protein, 763 aa, Homo sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 776257 - protein, 763 aa, Homo sapiens; identical to SEQ ID NO: 776256

SEQ ID NO: 776258 - protein, 763 aa, Homo sapiens; identical to SEQ ID NO: 776256

SEQ ID NO: 776259 - protein, 52 aa, Homo sapiens
WRPDQCLPRYQLAVTQRKEEEPSSSSVFNQNDPWAPTVDFSDFINNETIAGK

SEQ ID NO: 776260 - protein, 220 aa, Homo sapiens
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 776261 - protein, 215 aa, Homo sapiens [sequence omitted]

SEQ ID NO: 776262 - protein, 547 aa, Homo sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGKTFWWGEGFWKKG

SEQ ID NO: 776263 - protein, 112 aa, Homo sapiens
RRRRSEIGRWLCQERLLSKPGGHCPVSPFGPLLVLLVGLGGLSARSLGRRSTGPFTEATHGAGVSGSHRQAPSVQMQLPGSGRRELASSSQERLSVVGRVAGVGCAGAVGQH

SEQ ID NO: 776264 - protein, 112 aa, Homo sapiens; identical to SEQ ID NO: 776263

SEQ ID NO: 776265 - protein, 34 aa, Homo sapiens
IFEDSSFNPPLLLPQNYIEVEQEGKAVEKNTALK

SEQ ID NO: 776266 - protein, 129 aa, Homo sapiens
SATEPCIGSKAPKHDKSRGADNPVADLKKHVEFLVAEKERLWKESKQVKAEKARLLKGPVEKELDVGADFVEKSELRSSPLHSETAIPSSALQRFAADARKAKYIPIPNLFPQIFHLQSFPLWSFLRIF

SEQ ID NO: 776267 - protein, 129 aa, Homo sapiens; identical to SEQ ID NO: 776266

SEQ ID NO: 776268 - protein, 62 aa, Homo sapiens
MAAADGGGPGGASVGTEEDGGGVGHRTVYLFDRREKESELGDRPLQVGERSDYAGFRACVCQ

SEQ ID NO: 776269 - protein, 103 aa, Homo sapiens
VETEFCHVGQASLKLLPSGDLPTSASQTAGITGVSHHVRPINNSFYLIFPTLKPTIPLIYNPSSTQVKNCLVLLTCKTTAYPSGISSSPTNQKCIFIKPSLNR

SEQ ID NO: 776270 - protein, 56 aa, Homo sapiens
MVFESASDKKKGTCQIHSGRFKTQWQLHPVPICTISKCSWMPMLEPLALLPLGTGC

SEQ ID NO: 776271 - protein, 227 aa, Homo sapiens
MFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 776272 - protein, 254 aa, Homo sapiens
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 776273 - protein, 184 aa, Homo sapiens
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 776274 - protein, 243 aa, Homo sapiens
MAEAVLRVARRQLSQRGGSGAPILLRQMFEPVSCTFTYLLGDRESREAVLIDPVLETAPRDAQLIKELGLRLLYAGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 776275 - protein, 108 aa, Homo sapiens [sequence omitted]

SEQ ID NO: 776276 - protein, 106 aa, Homo sapiens
APHPQSCGSAETPQLEQSEGHTHLRLPSQLPLQGAGPSSGAPARPYPQNHCLGSGPDNRKLGALSLHCLSFPARPCWRGETAPPPGPPPPAAEGGGIRHSSPLLRK

SEQ ID NO: 776277 - protein, 110 aa, Homo sapiens
LAQETRPTMEFKDNPTKEKTSRVGDAWAPRTGGELHFPQMERFLTPGQLSRNMAGLPDPNSPSFLAALVTTGPSSSEAWTKEALARTGFGGQWVEKSVLAAPWSPWINIC

SEQ ID NO: 776278 - protein, 67 aa, Homo sapiens
EPCGSRGGDWTQPHDNAQTWARNWKPVVPLGCRGWGPTVMAEPGPHTQQHGLQTRAGPPFWSQGDLG

SEQ ID NO: 776279 - protein, 610 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 776280 - protein, 399 aa, Homo sapiens
MISSPPKSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 776281 - protein, 600 aa, Homo sapiens
HEGAACAAVPSVGCKRGGRRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 776282 - protein, 399 aa, Homo sapiens; identical to SEQ ID NO: 776280

SEQ ID NO: 776283 - protein, 301 aa, Homo sapiens
VPRDQQEITAYSGSAPPLKLTAAVCVFVLEVSKTASPPGGADDSGRAIFKSCNTHREVRGFILKVGETNNPAEGINSAHREKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 776284 - protein, 312 aa, Homo sapiens
RPDRAPSRRGGSCRSRRARGERPGGAEGAGGSEDAGTGTRLPAGGVSERLSAARSAHPFRTAPSLRASEEAPRAVRRRLGCRAAEPRPSKREKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 776285 - protein, 261 aa, Homo sapiens
MRLPEQPGEGKPENEKKGDGGALGGGEEPPRSQAPDFPTWEKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 776286 - protein, 215 aa, Homo sapiens
CWSQELEEILAAEVKIAKLWNQPKSPSTNEWIKKCEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 776287 - protein, 170 aa, Homo sapiens
CIDVIFFFHTLFLLDFSSKACSAASSLRRSGAVDGYFIVSAAHRAGPGDPALSQSCKSTLRCAFPGGGCLPLLPLPLCPSSSSARELRSPTPGLSGQPAPAASPGPGLQVAPATAARRASSLCSTLTAVPRAAFLASFRPACLLSLSAGAFGSLSPQQPPPAASPGAGAA

SEQ ID NO: 776288 - protein, 119 aa, Homo sapiens
VRNPRPGTRAGPSLAEGRPGTRVPTRDHRTHHHHSGNCPAAPRSPGPAAEVGPRAQRPRNSARSPQPQCRGARWPRATPHPAPGAHRWPHNFAARAAPAGPSTLPRDLPNVECVPAPSR

SEQ ID NO: 776289 - protein, 53 aa, Homo sapiens
CWSGGAGAQARGAAVAATFLRRFGEGPLISTRPAPAALASGRGGGKTGDWQQG

SEQ ID NO: 776290 - protein, 217 aa, Homo sapiens
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 776291 - protein, 238 aa, Homo sapiens
VLQRTPLLYVTSTAQRQGGERMSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 776292 - protein, 241 aa, Homo sapiens
EEARINRKRASWPLCCKLVVKVIYYCHFSSAKGCFGTSVACSAGDWLFFLANQLFKFLVFKKLCGGTVTEEVPARRKYPAGGCVRKARARGARGAVLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 776293 - protein, 217 aa, Homo sapiens; identical to SEQ ID NO: 776290

SEQ ID NO: 776294 - protein, 572 aa, Homo sapiens
AAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 776295 - protein, 513 aa, Homo sapiens
AAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 776296 - protein, 572 aa, Homo sapiens; identical to SEQ ID NO: 776294

SEQ ID NO: 776297 - protein, 411 aa, Homo sapiens
AAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTR

SEQ ID NO: 776298 - protein, 45 aa, Homo sapiens
AVCSQAKVWTGLGTACESYPRKYKITFTQQDTALPASEVTQIKAS

SEQ ID NO: 776299 - protein, 43 aa, Homo sapiens
PAELACHSPSVLFWLKNESLGLSCLGVLRNSDVCEPGSGTLKF

SEQ ID NO: 776300 - protein, 87 aa, Homo sapiens
ETPGAGEGEVDFLLVFPSHETSWLGGNRRVSSSSLEESTFLQGWGSAEWEEDTNTNFIARMQKEASAVARAWNPSTLEGELGGSLEM

SEQ ID NO: 776301 - protein, 115 aa, Homo sapiens
RVFEGKNADLHRMHKINVTVWRGNQPDLGYGSDQDIFGSRVKRNLIISRLETGQTCKIENRMKLKVFWIWRSRNKFYGNIWFKYTYLKHRSETGFPLKKKTLAEAPSLGKEAEKS

SEQ ID NO: 776302 - protein, 810 aa, Homo sapiens
MPMDLILVVWFCVCTARTVVGFGMDPDLQMDIVTELDLVNTTLGVAQVSGMHNASKAFLFQDIEREIHAAPHVSEKLIQLFQNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 776303 - protein, 790 aa, Homo sapiens
MESGSLSPRLECSGATLAYYNFLLPGSSDSPALASQVAGITDIEREIHAAPHVSEKLIQLFQNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 776304 - protein, 763 aa, Homo sapiens [sequence omitted]

SEQ ID NO: 776305 - protein, 555 aa, Homo sapiens
MPMDLILVVWFCVCTARTVVGFGMDPDLQMDIVTELDLVNTTLGVAQVSGMHNASKAFLFQDIEREIHAAPHVSEKLIQLFQNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKVVRMLAP

SEQ ID NO: 776306 - protein, 311 aa, Homo sapiens
MERRRLLGGMALLLLQALPSPLSARAEPPQVRKPVWVPCNQSYICDFRTLLWTVSVLQRTTMNSGGSGWMWMPLPPQGPQCCGGAKVGSVTHASYPNSISLSLQGQISTYLLGQRDVFEKPPGYRRLGLCPEDDILCVTGYQAWCTDTEPYQKAERDTPFRDRGGHVIGTHDLEQRRKAQYVLRTVYRCCPCHCHAYSHASKTRDRARMRKDTDADQVINEEPAGRYRQTTSTPRGTPSTRRKQDPTHDRLTMPRERYRDARAEATHKRTNRTRAETEAREAREGIAATHYGPTKTPETQPDKHSANNYTT

SEQ ID NO: 776307 - protein, 879 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 776308 - protein, 842 aa, Homo sapiens
WLPGRVRTIAGSPGKWAQAPPEDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 776309 - protein, 783 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 776310 - protein, 309 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIEPDSLPASYPVQWTQVTGLTLRAYMGASLLVVLVEYTFLHRRR

SEQ ID NO: 776311 - protein, 76 aa, Homo sapiens
SFDITNVVRDVNSIELRFQSAVLYAAQQSKAHTRYQVPPDCPPLVQKGECHVNFVRKVMVSQTGRVLFLRTGCAGI

SEQ ID NO: 776312 - protein, 166 aa, Homo sapiens
MLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITVSTGHGGGQGTVALWGSPALGPAPCILRFACVPLGAEFT

SEQ ID NO: 776313 - protein, 844 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITVSTGHGGGQGTVALWGSPALGPAPCILRFACVPLGAEFT

SEQ ID NO: 776314 - protein, 225 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYE

SEQ ID NO: 776315 - protein, 138 aa, Homo sapiens
SLQTEAQVASDLPKSTRLWEVEQGFKGGPEATQPGWVSKAIFFSSLLHPFIVESKPAPQELPFIPSLSPLCSSSSRLPHAPPTLKFPATPRPVPACLCRLSVLGAGEQVLSPLCCPQKSQNILAPPSLGPKPFRVPSF

SEQ ID NO: 776316 - protein, 75 aa, Homo sapiens
QRLGQDSLTPEQVAWRKLQEEYYEEKRRKEEQIGLHGSRPLQDMMGMGGMMVRGPPPPYHSKPGDQWPPGRWCAA

SEQ ID NO: 776317 - protein, 114 aa, Homo sapiens
NIKKSGLFGSWFCTFVQSLTVPTLTCPLPRGLSEPFRNAAAVIRNFENLPRALEGVSRPGRFLVTAKGEQQGGEGNLIPQRQTELSLKTLAQHFPAGDDPGQVSRLPVLQFSLL

SEQ ID NO: 776318 - protein, 114 aa, Homo sapiens
RGPSSGAERVWLKPQVCGRLLGLRELRLPGGSRASSFARGFEAASPEIRSFWGRTAAVGIWFTQIRQPPSAWAHSVSGAQKAASSGSFLSTAVQPPGSGEPGFAGSALTPVCGG

SEQ ID NO: 776319 - protein, 88 aa, Homo sapiens
TGNGIANLVAARAGYSGLAQDSGRPHIPLVLLPRALASREKSWDHVEYGEYPFLFEKLLLGHRERWGGQRLGPWEVPGSDLFGLAVEG

SEQ ID NO: 776320 - protein, 351 aa, Homo sapiens
LGSCGAPGVAMNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 776321 - protein, 333 aa, Homo sapiens
LGSCGAPGVAMNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 776322 - protein, 351 aa, Homo sapiens; identical to SEQ ID NO: 776320

SEQ ID NO: 776323 - protein, 351 aa, Homo sapiens; identical to SEQ ID NO: 776320

SEQ ID NO: 776324 - protein, 351 aa, Homo sapiens; identical to SEQ ID NO: 776320

SEQ ID NO: 776325 - protein, 351 aa, Homo sapiens; identical to SEQ ID NO: 776320

SEQ ID NO: 776326 - protein, 263 aa, Homo sapiens
LGSCGAPGVAMNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELPADAIGWESILPLVALIFDDTGSVQ

SEQ ID NO: 776327 - protein, 75 aa, Homo sapiens
GSLCGAPLQGLGCSIPSASAVPFVPLEPLAGPCIDKPSDQKWGLTARGLSGGSRATRAGGGSYAEDYDSDATRTY

SEQ ID NO: 776328 - protein, 419 aa, Homo sapiens
DSLVWQVVSQTVHALKFCLALLKSKRKVKGRNKNKKKDYIDFKIMQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 776329 - protein, 610 aa, Homo sapiens
GCKRGGRRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQAPRAKVPPSRTLSASPTCCDFYDGICKWEEGSPTPVLHVGWATFLVQSLGRFEGQVRQKVRIVSREAEAAEAEEPWGEEAREGRRRGPRRESKPEEPPPPKKPALDKGLGTGQVQCQDPPGSLLGLSLAQPEALKVAARLRCQQPQASPPAEGPVLTFQSEKLKGMKELMVATKITRAPFKACSHGTVAVADEEAESVHPSG

SEQ ID NO: 776330 - protein, 386 aa, Homo sapiens
MISSPPKSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQAPRAKVPPSRTLSASPTCCDFYDGICKWEEGSPTPVLHVGWATFLVQSLGRFEGQVRQKVRIVSREAEAAEAEEPWGEEAREGRRRGPRRESKPEEPPPPKKPALDKGLGTGQVQCQDPPGSLLGLSLAQPEALKVAARLRCQQPQASPPAEGPVLTFQSEKLKGMKELMVATKITRAPFKACSHGTVAVADEEAESVHPSG

SEQ ID NO: 776331 - protein, 555 aa, Homo sapiens
MGDRGQDSSLGFGGLTWVRFWTDFTAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQAPRAKVPPSRTLSASPTCCDFYDGICKWEEGSPTPVLHVGWATFLVQSLGRFEGQVRQKVRIVSREAEAAEAEEPWGEEAREGRRRGPRRESKPEEPPPPKKPALDKGLGTGQVQCQDPPGSLLGLSLAQPEALKVAARLRCQQPQASPPAEGPVLTFQSEKLKGMKELMVATKITRAPFKACSHGTVAVADEEAESVHPSG

SEQ ID NO: 776332 - protein, 575 aa, Homo sapiens
GCKRGGRRPPPAAMGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQAPRAKVSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQVQCQDPPGSLLGLSLAQPEALKVAARLRCQQPQASPPAEGPVLTFQSEKLKGMKELMVATKITRAPFKACSHGTVAVADEEAESVHPSG

SEQ ID NO: 776333 - protein, 124 aa, Homo sapiens
MAVGLCKAMSQGLVTFRDVALDFSQEEWEWLKPSQKDLYRDVMLENYRNLVWLGLSISKPNMISLLEQGKEPWMVERKMSQGHCAGSHSVAQAGVQWHDLGSLQPIPTELKQSSHLSMHTTAPG

SEQ ID NO: 776334 - protein, 609 aa, Homo sapiens
MAVGLCKAMSQGLVTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 776335 - protein, 95 aa, Homo sapiens
PFSDVHFVSTLEPLSNAVKRNVPRCIIILVLQEPAPFRISVTSSCFVQNTLTKLLKDDEFLSFVGTRMKMETIILSKLSQGQKNKHCMFSLIGGN

SEQ ID NO: 776336 - protein, 192 aa, Homo sapiens
FKISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSK

SEQ ID NO: 776337 - protein, 36 aa, Homo sapiens
DTLQDEINHHTSTPCHPGAHTHLLTPRLISTKGDNK

SEQ ID NO: 776338 - protein, 67 aa, Homo sapiens
MGSVCGSCCPWLAHSAGGLCGLSSVATRTQGLWVSGLVPTLPLGRLPGWRPCSRVLGPLDAKCWPEQ

SEQ ID NO: 776339 - protein, 41 aa, Homo sapiens
TPMGIQYSSSSISKQHFHNVMELTFKTRRLGVFESICSLTP

SEQ ID NO: 776340 - protein, 48 aa, Homo sapiens
AVFSNDSHIKLGDGIHPKDKRANQERGRHQIEEIRIPTMERSEKKKIL

SEQ ID NO: 776341 - protein, 551 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776342 - protein, 588 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPGNLIKHLVKGTRPLFLETRIPWHMGHSIEEIPIFGLKAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776343 - protein, 478 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776344 - protein, 79 aa, Homo sapiens
RRWIRCCCRGGRTCRRRRRRRRPRLKEDGGRRGPHRHLRGCRRRVQPDYRERSRERERHRDRDRDRDRERDREREYRHR

SEQ ID NO: 776345 - protein, 79 aa, Homo sapiens; identical to SEQ ID NO: 776344

SEQ ID NO: 776346 - protein, 551 aa, Homo sapiens; identical to SEQ ID NO: 776341

SEQ ID NO: 776347 - protein, 551 aa, Homo sapiens; identical to SEQ ID NO: 776341

SEQ ID NO: 776348 - protein, 535 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSRDYRERSRERERHRDRDRDRDRERDREREYRHR

SEQ ID NO: 776349 - protein, 588 aa, Homo sapiens; identical to SEQ ID NO: 776342

SEQ ID NO: 776350 - protein, 499 aa, Homo sapiens
MDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776351 - protein, 478 aa, Homo sapiens; identical to SEQ ID NO: 776343

SEQ ID NO: 776352 - protein, 402 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKIPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776353 - protein, 182 aa, Homo sapiens
MPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776354 - protein, 551 aa, Homo sapiens; identical to SEQ ID NO: 776341

SEQ ID NO: 776355 - protein, 551 aa, Homo sapiens; identical to SEQ ID NO: 776341

SEQ ID NO: 776356 - protein, 310 aa, Homo sapiens
MADGVDHIDIYADVGEEFNQEAEYGGHDQIDLYDDVISPSANNGDAPEDRDYMDTPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776357 - protein, 329 aa, Homo sapiens
MTIHVQKRYKIYETCEKPSSQGQELSESLTSSKGNLHHKKYEQFLNSLLRLSVVQNLYHFFKPTNTSKCVETVRSAMYKSMSTISRVLAKPRLSKSTPCTVPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776358 - protein, 238 aa, Homo sapiens
SYLEDPRLGIPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776359 - protein, 132 aa, Homo sapiens
RNCSYQCLNSTPIITSTGIRHSSRNSTAGDCPISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 776360 - protein, 182 aa, Homo sapiens; identical to SEQ ID NO: 776353

SEQ ID NO: 776361 - protein, 551 aa, Homo sapiens; identical to SEQ ID NO: 776341

SEQ ID NO: 776362 - protein, 79 aa, Homo sapiens; identical to SEQ ID NO: 776344

SEQ ID NO: 776363 - protein, 120 aa, Homo sapiens
AGWYWSGMLGWRAGVSDPQSSRTFGSSRCGCDPREGAGLVGLLQPVSVGWRWGLEPPRPAFGRCRRNPLAAALRREQGLGPSAGWELRSPECRFPSGAGAVACLCGPRILKENESGTLQK

SEQ ID NO: 776364 - protein, 1120 aa, Homo sapiens [sequence omitted]

SEQ ID NO: 776365 - protein, 903 aa, Homo sapiens
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGDEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFV

SEQ ID NO: 776366 - protein, 713 aa, Homo sapiens
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGDEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERLGENDSDGEMIALNQWDVLVFPKPVELRLRLIFGEK

SEQ ID NO: 776367 - protein, 78 aa, Homo sapiens
TELFKCETSIAQQRELIIPSDPFWVPTTEEEYLHFGEKADSENQARKYMNAVRKRKGLYVEEKIVEHAEKQRTLSKNK

SEQ ID NO: 776368 - protein, 1120 aa, Homo sapiens [sequence omitted]

SEQ ID NO: 776369 - protein, 584 aa, Homo sapiens
MVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 776370 - protein, 79 aa, Homo sapiens
RILNQQKPPNELTQKTLIIPSDPFWVPTTEEEYLHFGEKADSENQARKYMNAVRKRKGLYVEEKIVEHAEKQRTLSKNK

SEQ ID NO: 776371 - protein, 281 aa, Homo sapiens
SCRDLSSRNYVRKEGVHILTGLPSKSPSGPCTANSKTPVTSEIRSAWDCASVRPPNLKLQLLFDCSGLLPVCHSDLQPLSETLLLLLYCFGGSCSPQMNSVTSQATRHCELLCCCPSQNPVLERRAPCASCQVMGGSVPGQSPRGDGDLQNSNALCSYSLFFCSCSVAFIWFPFEFPAPISLQRLLMSQASEHIRSSQRLSPGEAAMHFTKQTSPWAAGPFGCHDNVGSLCRGVCCALILASQGPLPQLSFPDPFNRLPASWRHLHINCCSIWSSFVLISK

SEQ ID NO: 776372 - protein, 85 aa, Homo sapiens
GRRGIHHVHPGLGQVKHQPQQEVLKESSGPALSPCEDDWEDCTSVGEDLQTGLRGESSLQPFKAKTGQGERMKGGRWCPPHLSQV

SEQ ID NO: 776373 - protein, 94 aa, Homo sapiens
ERVRVTSPPPTCLPTVILKENCFMKDAEGSQTPPETFYRNNLSMPFLSGVLGPNTFILLIFLCQTKFQTHWNLHSMCGSNRHVCSTIPSCNSPV

SEQ ID NO: 776374 - protein, 414 aa, Homo sapiens
ACGGHQAGLGQPKMRARPLTANAQPPGTQDRPRVVGWALCQMTAGECLGARWPRLVQGPPCAPTVCWGRGHSRSGSHPLEAPSPARDQLGVAVGGQCCMGWPALRDAGAPLQGSMVHSTSAHGSYEEHKEGFLDKQCGKQPEYLTGGLRQLTPLRESQQRCTDKGTSDQQEQRKHALGQTAIQRLRVHYLTNPSGTQKKQHATRTHDQQPATRLQPSHWTPKVQMATTGEDTHRENTQTRINLTKRATRTADTQAGIPMEPEHAIRTRTLTWDGNRKCEPQLHGTSTTPTMAPPHRPIPKPTVHHTHRQQASAHCTASYQRRRQYHTSSPHESARSHTVSDPSPPPPVPAPTHTNLTLHYPLTSLLLLTCYTTINLAPCTLPQYNKTPPLPPSNISPTKYSNTLIHLIILPSIP

SEQ ID NO: 776375 - protein, 472 aa, Homo sapiens
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 776376 - protein, 564 aa, Homo sapiens
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 776377 - protein, 304 aa, Homo sapiens
ARSISSLTRFNFLSFNFLWGRPSHLPCLAEEARLREGEELAQGHTAAKWPRPEGAPARRRGQRSPLPGCCYWDTRAAPSPGLRRGCWSGSRGARACSPRSARDAGASEGSGGGLGGGGAEARLRAGGGGWMPERPLTPAHPQSPSLRKHAVPLLPHGCGAWAGRGGGGGHRGGDPAPSPGRSVPPHPRERRAGPDPSRSIARPGSAPVPPRSGPRAGAAQSLAGPRGPGRALRRAPAPASGRSAQAEARAGRPRRSGRRDVRGSEKQPTHLIRSKCLEVGRTKWERPTLTPHPVETGNTRRDIF

SEQ ID NO: 776378 - protein, 101 aa, Homo sapiens
CEGENCKASQGYASYGMIPGVKGIYSRGVMFRKDPLRTGMSLETSYQLKLHPWPAEYPLLPSITLRIHSPSLLGFFFFKLSDFPAPKLLPLQYLQNWGPRW

SEQ ID NO: 776379 - protein, 66 aa, Homo sapiens
TVMRVNTLNSLSERIPVRGSQCSIYALKCSIPMLEGNVLWFNSVNTYQLVRLVNLAVSNKYPNLTS

SEQ ID NO: 776380 - protein, 132 aa, Homo sapiens
MSAPFGPVDFLQSLGGGEWGLLPALGAAAVQAPITSVKMDLESGNSEHGYGCRSAHDEGIGGQFNGGGPEPMGSGVGIGDLTRFLFIAQAPRLRDIGATHNSVQTQQRHNESRRAKTEDTHQLSSSSWRRLV

SEQ ID NO: 776381 - protein, 104 aa, Homo sapiens
MAEGEGKQGTSSQGGRRIVKQRRKSPIKSLDLVRTHYHKNSMEETTPMHLVSLDTWVFVEITIEDEIWVGAQSLTTSVDVNQKVKSDTEDVEKREQTIQSWWGI

SEQ ID NO: 776382 - protein, 51 aa, Homo sapiens
PPPPAKPSLTSPLHTKLLDKAVHILHPYFVISHSLCNPLQLASVPGFEIGD

SEQ ID NO: 776383 - protein, 102 aa, Homo sapiens
LYLNHKGRCVLTLAQSKILSSLEDRGLSLYPSVHGTVLGTQSLFGEINLRKDRGAQELIPKAHNYSLECRATGEEQTAGHARLGRGHALRCFPFLPEIREVS

SEQ ID NO: 776384 - protein, 102 aa, Homo sapiens; identical to SEQ ID NO: 776383

SEQ ID NO: 776385 - protein, 113 aa, Homo sapiens
PSSPLCPPPLLSVCSWNTCLSFHALSSALPGEAGRCSGHHRDNLCGRLSCNLPQISIRILLFPTLSFKGKWASWVGKGWWVLPAQFSDAQGRYYPQFPRAIILFHTYRVSHVR

SEQ ID NO: 776386 - protein, 186 aa, Homo sapiens
MWATCAIVWSSWTTAFWAPSGAKFAGSPIIGELDIHRDTRQGLPPRLNEPTLTTALTPDTTAQQRPAATHPDATTTHRGPTTPTLEHHHTHARSKAAEETHGLIPHQMSAKEKTQHHLTDNPAQETSRSATSTRARDATAAGTPKADQKRDDEQPSKRRRRTNGNNKEERRRRARTPTTQTTAHQQ

SEQ ID NO: 776387 - protein, 119 aa, Homo sapiens
MSLPKKRAQTRERTDGAETCKTKGGFQQVGGPKKAGVQKNRLETTVQSKENLIRAQTKKEKRTAPRKTEKKTNPRTKRTTKPTEERGTKTQKDNGGARREDRRKEQEREEEAKKEESAK

SEQ ID NO: 776388 - protein, 105 aa, Homo sapiens
MTRVLTGTRRWQPRRKLPARARPARDSHISSQRMGVMRPCRPICPVLWGRGSCGTGQLQHSQLWHQLQVRNVRRDPAPSTSEGPWQTGGCRHLRVPSLPTRQCAW

SEQ ID NO: 776389 - protein, 201 aa, Homo sapiens [sequence omitted]

SEQ ID NO: 776390 - protein, 445 aa, Homo sapiens
RRRPGRDPGRALRSRPVACALTPAASPARGPSAAGPRLAGCGSGLKMDEDGGGEGGGVPEDLSLEEREELLDIRRRKKELIDDIERLKYEIAEVMTEIDNLTSVEESKTTQRNKQIAMGRKKFNMDPKKGIQFLIENDLLQSSPEDVAQFLYKGEGLNKTVIGDYLGERDEFNIKVLQAFVELHEFADLNLVQALRQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 776391 - protein, 445 aa, Homo sapiens; identical to SEQ ID NO: 776390

SEQ ID NO: 776392 - protein, 351 aa, Homo sapiens
MTEIDNLTSVEESKTTQRNKQIAMGRKKFNMDPKKGIQFLIENDLLQSSPEDVAQFLYKGEGLNKTVIGDYLGERDEFNIKVLQAFVELHEFADLNLVQALRQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 776393 - protein, 114 aa, Homo sapiens
KVPGTERGRIPSTGELWGALSVEALSCESRRNTCYVVSREWLPWVRRWGRGRMLVTCWQCPTREKPLHRTLRHDAPTLSKCVGISVKCLRSQPGGQRPQGRSCRLRGRVRFPSK

SEQ ID NO: 776394 - protein, 122 aa, Homo sapiens
NQAVTPVFSAHFLHLAFRTPGDPGSPPTSLAPSVVLPSLMEFRSRADNPHVRISGHPFPPKHHMCIHAHLTSHLDVDQLSPTCPKQNFGSPLPTPSFSINLFLLPQSSPPRGWCLPPTEVTA

SEQ ID NO: 776395 - protein, 45 aa, Homo sapiens
QQSQDLHNIKQFQLMNHQTVMDSPALPAMATALTGQEADCSNFLL

SEQ ID NO: 776396 - protein, 140 aa, Homo sapiens
AESSPKMAATMKKAAAEDVNVTFEDQQKINKFARNTSRITELKEEIEVKKKQLQNLEDACDDIMLADDDCLMIPYQIGDVFISHSQEETQEMLEEAKKNLQEEIDALESRVESIQRVLADLKVQLYAKFGSNINLEADES

SEQ ID NO: 776397 - protein, 140 aa, Homo sapiens; identical to SEQ ID NO: 776396

SEQ ID NO: 776398 - protein, 140 aa, Homo sapiens; identical to SEQ ID NO: 776396

SEQ ID NO: 776399 - protein, 71 aa, Homo sapiens
ALSVCGSAPGQPRRGAGAGAGSLEGRRSASRDAEGAPGESEEPAAPASPLRCGKPKVPLSVVGLDSGVAPA

SEQ ID NO: 776400 - protein, 71 aa, Homo sapiens; identical to SEQ ID NO: 776399

SEQ ID NO: 776401 - protein, 71 aa, Homo sapiens; identical to SEQ ID NO: 776399

SEQ ID NO: 776402 - protein, 58 aa, Homo sapiens
GRQKPETETGAQAKIEDGTQSLRKFPGCMFDRPSPRSLELGRPLELDRPLELVRPLEL

SEQ ID NO: 776403 - protein, 514 aa, Homo sapiens
ALAADTGAAAAPRCPPEMADPEVVVSSCSSHEEENRCNFNQQTSPSEELLLEDQMRRKLKFFFMNPCEKFWARGRKPWKLAIQILKIAMVTIQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 776404 - protein, 497 aa, Homo sapiens
MADPEVVVSSCSSHEEENRCNFNQQTSPSEELLLEDQMRRKLKFFFMNPCEKFWARGRKPWKLAIQILKIAMVTIQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 776405 - protein, 134 aa, Homo sapiens
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQVN

SEQ ID NO: 776406 - protein, 1114 aa, Homo sapiens
MLKEERKRELEEKVKAVEVDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVLEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 776407 - protein, 1484 aa, Homo sapiens
MCPEEGGAAGLGELRSWWEVPAIAHFCSLFRTAFRLPDFEIEELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEGDSCADQNRKTKAQRGGRRASDSSSSAEEGAGADAKGREETRVGGEGQGSGRYVQCPRGLERCMSVDQPSLDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVLEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 776408 - protein, 498 aa, Homo sapiens
MCPEEGGAAGLGELRSWWEVPAIAHFCSLFRTAFRLPDFEIEELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGDSCADQNRKTKAQRGGRRASDSSSSAEEGAGADAKGREETRVGGEGQGSGRYVQCPRGLERCMSVDQPSLDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSGKQGRSLC

SEQ ID NO: 776409 - protein, 36 aa, Homo sapiens
QRFCICEKELHYFRKNLLESDDLSSDLGSDTNYVSL

SEQ ID NO: 776410 - protein, 284 aa, Homo sapiens
VSNTEFEKFVNSTGYLTEAEKFGDSFVFEGMLSEQVKTNIQQAGCFEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSQEYYDPYFQDVASEMLRRHTASRWKAFSSLEPCCSIRRHQQYAAIERLTCGKFELRCAVSTKYTLNFEDLV

SEQ ID NO: 776411 - protein, 248 aa, Homo sapiens
VSNTEFEKFVNSTGYLTEAEKFGDSFVFEGMLSEQVKTNIQQAGCFEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 776412 - protein, 113 aa, Homo sapiens
HEPLTLETVSPGLLVPCNKLYIPIPLLILKDSRAGEEGSIRAVDHAVIGGVVAVVVFAMLCLLIILGRYFARHKGTYFTHEAKGADDAADADTAIINAEGGQNNSEEKKEYFI

SEQ ID NO: 776413 - protein, 387 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHEIPEQVKKARSGQWIMP

SEQ ID NO: 776414 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 776415 - protein, 295 aa, Homo sapiens
MIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 776416 - protein, 382 aa, Homo sapiens
ERERERERERESVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 776417 - protein, 442 aa, Homo sapiens; identical to SEQ ID NO: 776414

SEQ ID NO: 776418 - protein, 354 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPAWCLWPLGASGLLGVS

SEQ ID NO: 776419 - protein, 387 aa, Homo sapiens; identical to SEQ ID NO: 776413

SEQ ID NO: 776420 - protein, 442 aa, Homo sapiens; identical to SEQ ID NO: 776414

SEQ ID NO: 776421 - protein, 442 aa, Homo sapiens; identical to SEQ ID NO: 776414

SEQ ID NO: 776422 - protein, 405 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHGLTQLPNSAEELDSEDLSEIPEQVKKARSGQWIMP

SEQ ID NO: 776423 - protein, 409 aa, Homo sapiens
MASVVLPSGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 776424 - protein, 217 aa, Homo sapiens
MISFAKHYTLCFCHTDKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 776425 - protein, 442 aa, Homo sapiens; identical to SEQ ID NO: 776414

SEQ ID NO: 776426 - protein, 67 aa, Homo sapiens
KGAGLRVGLGAEAPGRTTDVSPGLAGTQQVPRSTCQLAPSNAWLHLTERGRGPSRSLADPSFIPDSG

SEQ ID NO: 776427 - protein, 57 aa, Homo sapiens
MRWTARRPTWATVHLGSGSPSLGLCFLTCRTGVNNSAQVRVGRHERLRTTLESSLQP

SEQ ID NO: 776428 - protein, 257 aa, Homo sapiens
AYRSPALPGWVAVEARREFEHGTGRPAVLGDLAPPSAAAGPGAKPLTAPGLGAQAGCSECGGLPSPRPPGTHAGLQVCAQPWFPPAPLPPHLPTSRGSQLQPRPAQSGAPTVQRQAEGLLKRGQSGRGGRGGAKSELRAASTLSPLTMNNWQDSHGLDLRKVCSGLTYPRAAAPGSLSAFHISCINLVAHKDSIENKLMRIIPLIMEPASPASNQAMCTCTLDDSRIEASVDICLLFVSRVWWDASITVALSDGRQP

SEQ ID NO: 776429 - protein, 245 aa, Homo sapiens
RESAARLSPAGRTLGSFQPQKLRAPAYRDFFRAEKSSRALLTSFLLGGERSLSLGAAGRAMPRSRGRELGRCGCPAGRARGETGISALVPGAGSRWGRPPPPTPPPLLLLLGCGLLSVSAAAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEGKCLPHRPQEPEM

SEQ ID NO: 776430 - protein, 239 aa, Homo sapiens
RESAARLSPAGRTLGSFQPQKLRAPAYRDFFRAEKSSRALLTSFLLGGERSLSLGAAGRAMPRSRGRELGRCGCPAGRARGETGISALVPGAGSRWGRPPPPTPPPLLLLLGCGLLSVSAAAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEDRDDGKK

SEQ ID NO: 776431 - protein, 122 aa, Homo sapiens
MEQRGLGYKLERKEILACWGEGRGTDEGRRVLAKQELNEWPEAPSPKGSHSHWPGPVRALCHLLGHPLLQAFSTTGPQLSLLLPKVESPKVPSVWPILCPPPVASSSPPPLSLSAIGRSPGP

SEQ ID NO: 776432 - protein, 150 aa, Homo sapiens
IIIKYLYARYCWDDPSIHKLPPLSRHVIMSLTSLRLIMMPCCLEDKVQPPNHSFGAFCDPAFPYTSNFTDLPLTTYTFCTVFQIQWTSSTPHIHPLCLLFTDIWGVSPPPCSVSSLPRWGWATHFCFPKDPHACSSQSANYTAVNCGLFV

SEQ ID NO: 776433 - protein, 121 aa, Homo sapiens
VFLVVTGFHHVGQAGLELLTSGGPPASAAQSAGITGMSHHAWPSLILLRCNLGYPTPSGVQHKVCFQICTCVTCSQTRPQKDLRPGGSLSSLLPASHFCINTLVLSQFTTEQWPPLCQTVP

SEQ ID NO: 776434 - protein, 126 aa, Homo sapiens
MLLRLVLNSWIKQFSHLGLPKCWDYRYEPPHLVLGVFKAKTSTPLETNVKEPEEAGRVAAGVRCSWAKLQGLHFRAVFPGDRVGQLRGPLNLLHRTPRPENGSLIKGCYFLFVFPSTGLLMILVKK

SEQ ID NO: 776435 - protein, 332 aa, Homo sapiens
MVGAHLQLGREILDSINSCASRQVCLVIDAAKDLQTITLESGPSKHPVGVPRRARSVHYAAMKMQRMPFRRPSSAWTLGDSVWADVTYETPLDLLAVTWAPGTEPNDHGTTGHTETHNDSHEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKVPLALVESSAISATGQAKSSQGSDVNADVLAWRMQPIQRQENCIGLDTVPNISNVAAKHPGFRYNYRQCPKGGTRRKKGITRLEEPSHSCEVWPTRDDTSTHWLTRGKHTYTHAN

SEQ ID NO: 776436 - protein, 112 aa, Homo sapiens
MQRTHWPPPFPVKIPPWLPSAQETESKSLYLMRKDLLDMVPVSFSTLPWPGSASWSPSQKEINYSTCSSLRAMPFFSSMSLLMWTPCLCSKRTSRQNPLCLEELTVTPLCLA

SEQ ID NO: 776437 - protein, 193 aa, Homo sapiens
APDATAAEMLMPKKNRIAIYELLFKEGAMVAKKDVYTPKQPELADKNVPNLHVMKAMQSLKSRGYMKEQFAWRHFYWYLTNEGIHISVITFICPRRLCLPPYATAVQRLAGLGLKVWRVSDLQDSQEGKPTGIPTDGMLCSLVLTRKPMLGVGQQPNSSLEADLVVDMVSHLSKIGEDYFALNKLTAKKKKVK

SEQ ID NO: 776438 - protein, 79 aa, Homo sapiens
SLFPGSGHDPLHAKRTTINTEDVKLLARRSNSLLKYITDKSEEIAQINLERKAQKKKKSEDGSKNSRQPAEAGVVESEN

SEQ ID NO: 776439 - protein, 122 aa, Homo sapiens [sequence omitted]

SEQ ID NO: 776440 - protein, 138 aa, Homo sapiens
MEEEAETEEQQRFSYQQRLKAAVHYTVGCLCEEVALDKEMQFSKQTIAAISELTFRQCENFAKDLEMFARHAKRTTINTEDVKLLARRSNSLLKYITDKSEEIAQINLERKAQKKKKSEDGSKNSRQPAEAGVVESEN

SEQ ID NO: 776441 - protein, 122 aa, Homo sapiens [sequence omitted]

SEQ ID NO: 776442 - protein, 122 aa, Homo sapiens [sequence omitted]

SEQ ID NO: 776443 - protein, 155 aa, Homo sapiens
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 776444 - protein, 122 aa, Homo sapiens [sequence omitted]

SEQ ID NO: 776445 - protein, 122 aa, Homo sapiens [sequence omitted]

SEQ ID NO: 776446 - protein, 122 aa, Homo sapiens [sequence omitted]

SEQ ID NO: 776447 - protein, 90 aa, Homo sapiens
QKAHTPRSAPPDPFMVTEHMQEAAGIRKSSLLTFLAWWFEWTSQASAGPLIGEEAREVARRQEGAPPQQSARRDRMPCRNFFWKTFSSCK

SEQ ID NO: 776448 - protein, 155 aa, Homo sapiens; identical to SEQ ID NO: 776443

SEQ ID NO: 776449 - protein, 133 aa, Homo sapiens
MSPRRPATSAEQAEQGAGWRPTAESPQRSAARGRARQGGAAYFVRPRGPSLAPRRENPTWPRTTAPSRPSCVCPGSARSDGGGGGDRGAAAILLPTGTGKRGSGWAGAGRRRVSGQKSTRQPPAASHRHPAPG

SEQ ID NO: 776450 - protein, 122 aa, Homo sapiens [sequence omitted]

SEQ ID NO: 776451 - protein, 122 aa, Homo sapiens [sequence omitted]

SEQ ID NO: 776452 - protein, 122 aa, Homo sapiens [sequence omitted]

SEQ ID NO: 776453 - protein, 122 aa, Homo sapiens [sequence omitted]

SEQ ID NO: 776454 - protein, 125 aa, Homo sapiens
MQFSKQTIAAISELTFRQCENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 776455 - protein, 122 aa, Homo sapiens [sequence omitted]

SEQ ID NO: 776456 - protein, 27 aa, Homo sapiens
MHSAKRWLVKDQWHGEVSPGCTAFAAV

SEQ ID NO: 776457 - protein, 70 aa, Homo sapiens
GVRERRTKQVCSPGNDSTPSEKTGRVQTWPGSELENCQQGAEAEDSHCQGTASVTEETHRCGDEGGMRGW

SEQ ID NO: 776458 - protein, 139 aa, Homo sapiens
TQLHSYSCLEYCVQKDLAGCWWLLSFQLICPTLAPILSTQPSPPAAQYRLMATHHSLSVCRGFLCRRKTTYAYNVRIRHVDLYDPTWRMISIFLALMNLLLEYSSPYLMPSFSLLLKSYSSFMSHSRQAVSVIQVQEIH

SEQ ID NO: 776459 - protein, 201 aa, Homo sapiens
MRIKYLGIQLTRDVKDLFKENYKPLLKEIKEDTNKWKNIPCSWVERINIVKMAILLKVIYRFNAIPIKLPMTFFTELEKTTLKFIWNQKRAHIAKSILSQKNKAGGITLPDFKLYYKATVTKTAWYWYQNRDIDQWNRTEPSEIMPHIYNYLIFDKPEKNKQWGKDSLFNKWCWENWLAICRKLKLDPFLTPYTKINSRWI

SEQ ID NO: 776460 - protein, 93 aa, Homo sapiens
RGYATRRRASGTLSETRPTRPSPPRHTDQNPLLESDWDLFLVTDSASFCSWQVPFLQIPHLYRFRIRMFQQGSITAVSILRETTHLGNNSFLE

SEQ ID NO: 776461 - protein, 108 aa, Homo sapiens [sequence omitted]

SEQ ID NO: 776462 - protein, 77 aa, Homo sapiens
PDTHAQTHSHPRAHLDMDTHTGSHKHSHIQTPMRTLTLTGTPRHGYTGTHILGHPRIDTFTHGHTQTDAHEHRHALV

SEQ ID NO: 776463 - protein, 133 aa, Homo sapiens
RLLPEPPAQASCLEHRRTQPHCLLPPKRVQLQFPFQGATPSLQHPQPLGRAPSQLLNGVGMQRRPRETDAPPQRQSRGMGSGAILHMRVYVYTGMCLHAGTFMHAQACVCLHADVFMRVQACVFACRHVFMCA

SEQ ID NO: 776464 - protein, 944 aa, Homo sapiens
MMDLLRECDQRLSLGFWGPFCFLPPPVLRPSLSHAEKTGRLPRAEMSSPCSEAVKCLLREKGRVRIARFCSIPSRLLHLPGGASESLPARDSFPLEERVGRLGENPRASCGHVVFHLPCLIWHLYEPEGVVLDPNLSQMFQAEVFWQNRFCHFDKNRFAVFCDFESLTLSCSENQLLKLNLVCKICILHQQQKTPEPRGHFIDTVKQVRWDARILNCGGLSDFCHGKHCERCIMNVLNPLLSLAVFENAKKIRPLMERFGIHEKDRVPTTEETWLPCKTEHLYQEHGDLLSFGIRKKIKHWIGNILRSLCKRHTPAVQTEVLICKRYLRGKRSGFQTALASKEMACFPASLRTCTQKEALFPASLSETSRRNNTNRRGQAEYARRKVQSPGGREKMRRVTGNLPPALSHSRQPVGGDLVGGDIAAALGLPLTWGHCKFLTLFVFLPPWVPCMTGTHSRSWEHFMNDSGHAVKRLDVAPEKAAMVTPNKDQRNQEPLGLGSGHDSAPGFLCDVGTAISLLGHWVSCVYLGTVGWMSRALEFPSACGKPLFSLEHHCTVRVGLWQVLREVLVGDSRSKYREMLGSTHFIVKGYPFYESEDEQIDPGGNPHPRLPSVGVEVCILIAGKGAIKILESLINEGASVNEPVLDFLSFSFVRSMGFIFSSPGLLLCPLSNPAITSHLWALRSFTAVHIPFWQERICEIDSHYGNNEFMCNLSCACDTCSKEDWMKRVRLPEEEGVLMVGFQACDTHPSSGMPSCPPHQPGGWKLLGKETGQGLVGSLFGFIGLQIFTVQELKGDILPLSSSGSPWFGCGEEQVCFPAEPLPTPAGLVGASMEPAASACAHPSLNISPVLWAEHPLTSLQSVHTGPFSSQDEVKGTRLNISASEGEATEARNRMVAERSLGSLCRGSRGVGGCGPEEAASLWTGRKVASGGRGQGRMSLSQK

SEQ ID NO: 776465 - protein, 103 aa, Homo sapiens
ESCCPCCWGVWLMFSEPGMVQDRATGRHCRQQACAICDQAPCPWNFTPDSSGTPTLRKFQRPFKKFLLQLITVECQGLPSQNWFVLEQRTAILPRAQQGHCDP

SEQ ID NO: 776466 - protein, 114 aa, Homo sapiens
PIRVDLLKAVITEAVCSFLFHSALLHFQEVRTKLRIHLLAALITFLVYAGGSLTGAVFNPALALSLHFMCFDEAFPQFFIVYWLAPSLGILLMILMFSFFLPWLHNNHTINKKE

SEQ ID NO: 776467 - protein, 75 aa, Homo sapiens
PIRVDLLKAVITEAVCSFLFHSALLHFQEVRTKLRIHLLAALITFLVYAGILLMILMFSFFLPWLHNNHTINKKE

SEQ ID NO: 776468 - protein, 114 aa, Homo sapiens; identical to SEQ ID NO: 776466

SEQ ID NO: 776469 - protein, 67 aa, Homo sapiens
NQKSITSKVCNYKPTENKYMNSTTVNWTALGNTDEESQHRFVLQYLAPFSARLATPGIMPEKSPGRL

SEQ ID NO: 776470 - protein, 76 aa, Homo sapiens
EDIKTMKGYNLPTSFTRSVCIPSLLSGPLAQNVPTEGGAPGGCMKRLSPGGTPWTWGKQAMSAPEFWPMDRCPREL

SEQ ID NO: 776471 - protein, 164 aa, Homo sapiens
LSPRGASAAPAPGWWLLSERRGVVADSLGVQLRSPAGSVRFVSGLGFDLLQDSQPLPGRTVQEKMAPKSPDPGPLTFGDVAVAFTRIEWRHLDAAQRALYRDVMLENYGNLVSVGLLSSKPKLITQLEQGAEPWTEVREAPSGTHAVEDYWFETHDVSPKAQHF

SEQ ID NO: 776472 - protein, 161 aa, Homo sapiens
MPRLNTLSSSWGNGHSTSVAIPSVRASDIACLGARHAGKWSPWLGSGSWWQCDSTEGKYSFWKAVSHHYHTRHPYRTHHHLPLPLDSNKKTSLTLAFSECPVQWGDLAPHSDDLEWFVPTTMRSTGQMGQDRDGGGTGRGVGAGVGGGTGSYGIPGKVPDS

SEQ ID NO: 776473 - protein, 126 aa, Homo sapiens
HTNLYLSTPLSELQTYISTSLLDIFFETGSHSVAQAGAQWHDHGSLKPRPPDLSLPSSWDYRHAPPCLAHFFVFFLKRQGSTMLPRLVANYWAQAIHLPRPPKVLGLQARATVPGLHLAVLMAHKN

SEQ ID NO: 776474 - protein, 324 aa, Homo sapiens
GVGGGGGPPHETQRPGLERPALQRIMVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTQKIRKIEKRGMAEEELIRPGD

SEQ ID NO: 776475 - protein, 441 aa, Homo sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 776476 - protein, 441 aa, Homo sapiens; identical to SEQ ID NO: 776475

SEQ ID NO: 776477 - protein, 378 aa, Homo sapiens
ARGAGLARRRRAEAGPEGWGRRGGGGRRSAPLQLGFMSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 776478 - protein, 368 aa, Homo sapiens
PRDPPTTIRGRRGGGGRRSAPLQLGFMSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 776479 - protein, 292 aa, Homo sapiens
ARGAGLARRRRAEAGPEGWGRRGGGGRRSAPLQLGFMSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEGDPLPARQEGVKKKAAEYLKRAEEILRLHLSQLPP

SEQ ID NO: 776480 - protein, 292 aa, Homo sapiens; identical to SEQ ID NO: 776479

SEQ ID NO: 776481 - protein, 280 aa, Homo sapiens
ARGAGLARRRRAEAGPEGWGRRGGGGRRSAPLQLGFMSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEVSQSAEITGMSHYARPMSVCLDV

SEQ ID NO: 776482 - protein, 262 aa, Homo sapiens
MSKRWWSGSGTATSASCMETWPTPTATSSAASRSSPLSPGPRCLGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 776483 - protein, 401 aa, Homo sapiens
ARGAGLARRRRAEAGPEGWGRRGGGGRRSAPLQLGFMSRQAKDDFLRHYTVSDPRTHPKGYTEYKVTAQFISKKDPEDVKEVRLLGGRGTVLQFQIWKLLKGQLVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 776484 - protein, 356 aa, Homo sapiens
PRDPPTTIRGRRGGGGRRSAPLQLGFMSRQAKDDFLRHYTVSDPRTHPKGYTEYKVTAQVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 776485 - protein, 335 aa, Homo sapiens [sequence omitted]

SEQ ID NO: 776486 - protein, 213 aa, Homo sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPGNVFQLVRSQPQSQQCFILFHPNEFCYFQQFSFSFSQFLF

SEQ ID NO: 776487 - protein, 677 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 776488 - protein, 597 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGRSEALKRRVQPSWQREVEWGVLGHNGFREESQIPALPLYPWANGFTFVSL

SEQ ID NO: 776489 - protein, 677 aa, Homo sapiens; identical to SEQ ID NO: 776487

SEQ ID NO: 776490 - protein, 574 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNQQKEHEAEPFSGCAHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 776491 - protein, 574 aa, Homo sapiens; identical to SEQ ID NO: 776490

SEQ ID NO: 776492 - protein, 574 aa, Homo sapiens; identical to SEQ ID NO: 776490

SEQ ID NO: 776493 - protein, 574 aa, Homo sapiens; identical to SEQ ID NO: 776490

SEQ ID NO: 776494 - protein, 442 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDAPRDCHDHHYHYHHHCHHHRYHHHH

SEQ ID NO: 776495 - protein, 615 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGRRPPTWSVCSKGMSPLSTACSHTPATASWPPVASILLCGSGTPDQRVKTSQAESWKIWRVLHRPTSGA

SEQ ID NO: 776496 - protein, 574 aa, Homo sapiens; identical to SEQ ID NO: 776490

SEQ ID NO: 776497 - protein, 494 aa, Homo sapiens
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNQQKEHEAEPFSGCAHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGRSEALKRRVQPSWQREVEWGVLGHNGFREESQIPALPLYPWANGFTFVSL

SEQ ID NO: 776498 - protein, 194 aa, Homo sapiens
RYSGPFLQRDLGSWRPRLWTQWWSREVPVSGPLSLGAPGAQGHQPWRSPGLLPSTPNPTPCCWVLLYDPGCSGSTGAGHTCHGDSGHRAGEVGAHSLAATAISWALGELPPPPHLCSLQGEKCQLRPGELSHWGLRGPDATVSRAMGEMHRHACEAWGPYLPLAWPLSPPTPGQPQERGSVASLAHMIGSVATW

SEQ ID NO: 776499 - protein, 103 aa, Homo sapiens
ISVNFSSLPAQKNDAVLCAVPMNTTRRALLSDSAFQGASQGFEAASSLSSLKFFWISSMAWRDIFKTMEIFQDWQKGSPRHSAKTITNISYVKKNPKLKISGT

SEQ ID NO: 776500 - protein, 98 aa, Homo sapiens
VFGRWGHDWVRLRFWRLPNHFQPYGLGKLAYLSSLSDTTGFCDPWFAPGVKPSYLLSLAPLTTSVGVLTPAPALVLVHFLSPALLGLPEVTSVFKDLC

SEQ ID NO: 776501 - protein, 67 aa, Homo sapiens
LPALPAQVDHAAQGPWISSESDWWGHYNLVPCPQMPCRDNQWKSCVLSIRLLMSLQSSTLKLTSNHK

SEQ ID NO: 776502 - protein, 37 aa, Homo sapiens
LSIGEGGFWEGTVKGRTGWFPADCVEEVQMRQHDTRP

SEQ ID NO: 776503 - protein, 130 aa, Homo sapiens
LRPSELHGLGREAVPRAGLASPGELLAAGGGRAAGSSELIRKSRKPMTSLGTWASYASAGCHGSGSLSAAPRGHLLVGGARTFIHERGRTGPPLRPPRGRGGGITGFSAGQPWFGLSSAASWPRGLGQIS

SEQ ID NO: 776504 - protein, 133 aa, Homo sapiens
RLPQDWLPALKEPPGSPWHNSLHEAPSRRRAHCPEPDTVRDGGLTESRPRTGPPLDPESRPQASPSPGSPQTLSVGTQGLEPLDYILVALIWDLIFNLSNSGIKEKRLRQARPGFLAQAFGSLNKRKKSKRRK

SEQ ID NO: 776505 - protein, 248 aa, Homo sapiens
QVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 776506 - protein, 248 aa, Homo sapiens; identical to SEQ ID NO: 776505

SEQ ID NO: 776507 - protein, 248 aa, Homo sapiens; identical to SEQ ID NO: 776505

SEQ ID NO: 776508 - protein, 248 aa, Homo sapiens; identical to SEQ ID NO: 776505

SEQ ID NO: 776509 - protein, 248 aa, Homo sapiens; identical to SEQ ID NO: 776505

SEQ ID NO: 776510 - protein, 248 aa, Homo sapiens; identical to SEQ ID NO: 776505

SEQ ID NO: 776511 - protein, 248 aa, Homo sapiens; identical to SEQ ID NO: 776505

SEQ ID NO: 776512 - protein, 117 aa, Homo sapiens
MAGWQLAPWRWPPQPRPIGEEANVLVLWNGKGKKLLYCWAWERVRCSMTHTGIPHSPRHTQRRPHTTLVTLKKAAACLVRKPRVMFLSTEICTASQADPQGMGLMLGLGLLVLLAPC

SEQ ID NO: 776513 - protein, 106 aa, Homo sapiens
MIPILLATSKAWSSGASGHMPSSLHQVDSVLALATPMSWSLLPSSLHQVDSVLALATLMSWSSLPSSLHQVDSVLTLATQMSWNSFIACSIWCLLALTSTVDTSVL

SEQ ID NO: 776514 - protein, 71 aa, Homo sapiens
GFRPQEFGTIESSENMSRRYDSRTTIFSPEGRLYQVEYAMEAIGHAGTCLGILANDGVLLAAERRNIHKLL

SEQ ID NO: 776515 - protein, 67 aa, Homo sapiens
RQRIFLCLAEEGGPPSVEIATLTRENGKTVIRVLKQKEVEQLIKKHEEEEAKAEREKKEKEQKEKDK

SEQ ID NO: 776516 - protein, 67 aa, Homo sapiens; identical to SEQ ID NO: 776515

SEQ ID NO: 776517 - protein, 261 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 776518 - protein, 261 aa, Homo sapiens; identical to SEQ ID NO: 776517

SEQ ID NO: 776519 - protein, 261 aa, Homo sapiens; identical to SEQ ID NO: 776517

SEQ ID NO: 776520 - protein, 261 aa, Homo sapiens; identical to SEQ ID NO: 776517

SEQ ID NO: 776521 - protein, 261 aa, Homo sapiens; identical to SEQ ID NO: 776517

SEQ ID NO: 776522 - protein, 104 aa, Homo sapiens
MTLHRLLCDGPTAGNGPRRPPSGASQCQAWTPGPARGRAEGGGLWAGPRVGVASVLRSSELYKVQKTCLEDMTPGPLYFLQKVAYTKLNMPWKLLDMQAPVWEF

SEQ ID NO: 776523 - protein, 67 aa, Homo sapiens
RFPESRCSTIRDNTAVLEIATLTRENGKTVIRVLKQKEVEQLIKKHEEEEAKAEREKKEKEQKEKDK

SEQ ID NO: 776524 - protein, 166 aa, Homo sapiens
MTMTFSITYYQLPPLKPQSKHHLPLCSASIITQHHQRHHHFSPSQRSRQHLHHPSTHLQACNVPLITMITHPHVLRDIRDAPAQRARAYTQRTLSLGCRERDPITRTSYNAETSTSTILCPQSSSRHNVLSPRADSHSNHTGITRRRYQRLHRATEVDTQDTIYGI

SEQ ID NO: 776525 - protein, 261 aa, Homo sapiens; identical to SEQ ID NO: 776517

SEQ ID NO: 776526 - protein, 261 aa, Homo sapiens; identical to SEQ ID NO: 776517

SEQ ID NO: 776527 - protein, 261 aa, Homo sapiens; identical to SEQ ID NO: 776517

SEQ ID NO: 776528 - protein, 261 aa, Homo sapiens; identical to SEQ ID NO: 776517

SEQ ID NO: 776529 - protein, 70 aa, Homo sapiens
LSLCGSRRDFTDEETKAQRSKVTFQKVTQPVSDGRINPGLPDVAAQVLSSMPCWEEETKREKRVEMDGRR

SEQ ID NO: 776530 - protein, 38 aa, Homo sapiens
MSEEAGDETPDVDPELLRYLLGRILVGKRGTEGVGSPV

SEQ ID NO: 776531 - protein, 180 aa, Homo sapiens
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 776532 - protein, 180 aa, Homo sapiens; identical to SEQ ID NO: 776531

SEQ ID NO: 776533 - protein, 180 aa, Homo sapiens; identical to SEQ ID NO: 776531

SEQ ID NO: 776534 - protein, 122 aa, Homo sapiens
PIPWSTGGPQSGAWQLPPLSDEHAAQSKLLGQELPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 776535 - protein, 125 aa, Homo sapiens
PGGGAVKQDRWVGGGPRVDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 776536 - protein, 180 aa, Homo sapiens; identical to SEQ ID NO: 776531

SEQ ID NO: 776537 - protein, 199 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 776538 - protein, 180 aa, Homo sapiens; identical to SEQ ID NO: 776531

SEQ ID NO: 776539 - protein, 253 aa, Homo sapiens
MVTLGPPGIMGSLALRTRPWPTPSCSWLSSGSAASPTSPPQAWYSGARTGRPRGAPTCGPTDGSAWPATSGRAGREPSSFAPGALPSFGPGVTRPVLGSRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 776540 - protein, 153 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 776541 - protein, 181 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGAGLEHLLSAAQANWGPHPPIPRNHERCL

SEQ ID NO: 776542 - protein, 164 aa, Homo sapiens
MGYPGPPGNYGIAGSSHAAMADSELQLVEQRIRSFPDFPTPGVVFRCTHRPPSWRPDLRAYGWERVARDLRAGGAGTLVFRPRGPALLRPRRHQACPWVQGHLARPEGPRLLPRRHRPPGATPEGDPRGPHRLHRRLSWRFRKTPWSQDRGWSSWMICWPLVEP

SEQ ID NO: 776543 - protein, 128 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKEP

SEQ ID NO: 776544 - protein, 227 aa, Homo sapiens
MVTLGPPGIMGSLALRTRPWPTPSCSWLSSGSAASPTSPPQAWYSGARTGRPRGAPTCGPTDGSAWPATSGRAGREPSSFAPGALPSFGPGVTRPVLGSRDISPVLKDPASFRAAIGLLARHLKATHGGRIDYIAGECPVAASRALPPLRAPRAARGLCASAWGRAFGVLQGAPGRAPCLGRPGRVVRLSPRGRRAVQASFPQVPGPQPRTGVTELPGQLVSLECPS

SEQ ID NO: 776545 - protein, 153 aa, Homo sapiens; identical to SEQ ID NO: 776540

SEQ ID NO: 776546 - protein, 275 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGKGLPAANCCGSKGLVGVGQDLAVYMGCSLLLSRGCLVARPTPSSPHAFPSPTQGLAWSTCSLQPRPTGDLTLPSPGTMNAACELLGRLQAEVLECVSLVELTSLKGREKLAPVPFFSLLQYE

SEQ ID NO: 776547 - protein, 107 aa, Homo sapiens
MVHVTGLSAGSQPGTPCHRPTLAPGDSHAAESLLSLTLTGLDSRGFLFGPSLAQELGLGCVLIRKRGKLPGPTLWASYSLEYGKKVRGLGWPEEGQGQATVATLPQF

SEQ ID NO: 776548 - protein, 130 aa, Homo sapiens [sequence omitted]

SEQ ID NO: 776549 - protein, 154 aa, Homo sapiens
MGYPGPPGNYGIAGSSHAAMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKCVSLVELTSLKGREKLAPVPFFSLLQYE

SEQ ID NO: 776550 - protein, 878 aa, Homo sapiens
DVWKQFLEDVTTATVTILDQEAAGSLILPAPPIVVTLADYDHVEEVTKEGVKKSPSPGYPLVCVTPCDPHFPRYAVMKERCSEAGINQTSVQVQLGRWLPHTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTTRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 776551 - protein, 878 aa, Homo sapiens; identical to SEQ ID NO: 776550

SEQ ID NO: 776552 - protein, 878 aa, Homo sapiens; identical to SEQ ID NO: 776550

SEQ ID NO: 776553 - protein, 878 aa, Homo sapiens; identical to SEQ ID NO: 776550

SEQ ID NO: 776554 - protein, 310 aa, Homo sapiens
DVLEAVLGDVTTATVTILDQEAAGSLILPAPPIVVTLADYDHVEEVTKEGVKKSPSPGYPLVCVTPCDPHFPRYAVMKERCSEAGINQTSVQVQLGRWLPHTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVLDALFPSDRGDYRGELTDNDRDPL

SEQ ID NO: 776555 - protein, 643 aa, Homo sapiens
METSSSCESLGSQPAAARPPSVDSLSSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 776556 - protein, 571 aa, Homo sapiens
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 776557 - protein, 571 aa, Homo sapiens; identical to SEQ ID NO: 776556

SEQ ID NO: 776558 - protein, 571 aa, Homo sapiens; identical to SEQ ID NO: 776556

SEQ ID NO: 776559 - protein, 571 aa, Homo sapiens; identical to SEQ ID NO: 776556

SEQ ID NO: 776560 - protein, 571 aa, Homo sapiens; identical to SEQ ID NO: 776556

SEQ ID NO: 776561 - protein, 571 aa, Homo sapiens; identical to SEQ ID NO: 776556

SEQ ID NO: 776562 - protein, 571 aa, Homo sapiens; identical to SEQ ID NO: 776556

SEQ ID NO: 776563 - protein, 356 aa, Homo sapiens
MVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 776564 - protein, 203 aa, Homo sapiens
VTLTPSMGWLHRVIVADFQDESMIKLGYGLLICRMPLSLILQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 776565 - protein, 252 aa, Homo sapiens
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKILLITLAAL

SEQ ID NO: 776566 - protein, 584 aa, Homo sapiens
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQVCALQYTMGVFIHAVQLCLRKSSWKDYLCIFKTLLLPWQHSGTSCHQIREGPGLHIMEVDPLERAM

SEQ ID NO: 776567 - protein, 99 aa, Homo sapiens
QGSRHVRDVAKVDLEKGMLGAWEVEGHWRSWRWTERGRPHASKTRFHVCKMRWKAMPPRASGGWQVTERAPRASSSSRVPQGLAWAHQQQQAFRKDLLN

SEQ ID NO: 776568 - protein, 111 aa, Homo sapiens
LGSLLFEMVLTGQRGGQRGCKLPHGLMCAPRRELKPWGLVSRQQKNRLGRLGVVVHLCNPRKIGFGRPRQSDHFRSGIRDQPGQHGETPSLLKMQKKISQAWWLVPVIQLL

SEQ ID NO: 776569 - protein, 74 aa, Homo sapiens
MKSVRKRGQTLNQVPNAQPSLPELRTLARATPAPACRCLHSRSSFLGKQTVDQISKALSFPEFGRAPAQRSPSQ

SEQ ID NO: 776570 - protein, 69 aa, Homo sapiens
SKVVLEEAESPCLPLQRSTSRPVREPSSAPMQSLFLIGECLGTAFVCRCTHRWLRVLMQGCADVYKSRM

SEQ ID NO: 776571 - protein, 110 aa, Homo sapiens
MCGELTGMSQFGYIFLPGSAPFYGVLLNHLRYSIDMKYLALRDHFWSGEICAFLTQNRNLHKSIIGLHSVLTIIVHMPTLNANLGSPSTPTRWVLLLSLTFDQRDCLIRV

SEQ ID NO: 776572 - protein, 54 aa, Homo sapiens
MLVSANLLCFQSDKSPAHTVYPGKPKHWIPLDYTIIFIVILEHIPSAYILKSYL

SEQ ID NO: 776573 - protein, 79 aa, Homo sapiens
EGCGRETRRGGEEKQTPGRDRDGREMEGHLRYRELGPPNSSGFQGNGDGGAPGMIPSPWNGSELTPRTSQFHFNVPLTP

SEQ ID NO: 776574 - protein, 257 aa, Homo sapiens
EVTLERSLAGRSPLAVGSEVLEQVLHTLSKSGSLEELVLDNAGLKTDFVQKLAGVFGENGSCVLHALTLSHNPIEDKGFLSLSQQLLCFPSGLTKLCLAKTAISPRGLQALGQTFGANPAFASSLRYLDLSKNPGLLATDEANALYSFLAQPNALVHLDLSGTDCVIDLLLGALLHGCCSHLTYLNLARNSCSHRKGREAPPAFKQFFSSAYTLSHVNLSATKLPLEALRALLQGLSLNSHLSDLHLDLSSCEVSPQ

SEQ ID NO: 776575 - protein, 122 aa, Homo sapiens
MPQAPGQLMPGVHTPGQGSGQLMPGVHTPGQGSGQLMPGVHTPGQGSGQLMPGVHTPGQGSGQLMPGVHTPGQAPGQLMPGVHTPGQGSGTVDAWVSNSWKGPRDSDPGVQSWQALASVLGS

SEQ ID NO: 776576 - protein, 122 aa, Homo sapiens
RIKIFPFGCSNGGSQYNLSKMERKSKEKPKTARVSQSTEPGRGQNELAPAASPQGGCPEHLVQKLSPDKWSTPRGICSPALKAALGCGHNLLSISYITSAEPLASRIEIPTLFFHASSLLHH

SEQ ID NO: 776577 - protein, 114 aa, Homo sapiens
MRSVGFIRGFCFHLALILPACRHVRPAFRHDCEAFPATWNCESIKPLFLYKLPSLRNVFVTTDFYFLNWKMHMTSLISPYIKTHDEVLRGTRNHRDRKQNGGCQQLEGGGNGEF

SEQ ID NO: 776578 - protein, 50 aa, Homo sapiens
MVIVLYLSRKYQIRGHWYPPELQARTCVDEYLAWKHVTIQLPATNVYLCK

SEQ ID NO: 776579 - protein, 100 aa, Homo sapiens
VFIFQFVNFYSSPVYIAFFKGRFVGYPGNYHTLFGVRNEEVSVPEARDWGMSCVLPLTSILPFSFDLQQFLPPPAISIAQPGPAVQLTTQGSQPLFTTYS

SEQ ID NO: 776580 - protein, 115 aa, Homo sapiens
ERERGKDCLLEIWCEPDPRYPSVICTPGLEGGAGVGGVVKSSFQVALSIPGERGRQTQVLGPGTRGTVWTDMRGLVYPAEGLAFALEAVETVSQVGMAGSDLGFKSLPLAAKSLL

SEQ ID NO: 776581 - protein, 30 aa, Homo sapiens
QEPRQLTVETFHPVTLCLKGALGMKSEYAM

SEQ ID NO: 776582 - protein, 116 aa, Homo sapiens
LNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 776583 - protein, 109 aa, Homo sapiens
TGEKQPRPHGFRCSHGSKRAPALLGAPARRPPAHIPAQPRWPRLQPVAKRRARPVPPGLPGAPKQAALTPGRRPLTPAAFAPKASRDQQMGPLRCKEFNLSQVTQFGRG

SEQ ID NO: 776584 - protein, 224 aa, Homo sapiens
WIRILFGFRGFCKNIIICYITEYHPGAKKVSESTTKNDPVKNIHIESSHNIDLNKIAMNSNLQVVVKRLEDTISIAKKSWNNQPLSEGYKASKKLIEIDGKDQHADRNMTLTLNRMTCKEQSLSKSVVASGNIINSHCMPTVDLNNKRLENLKKSSILDMGRLISSVENVPAKYEGTESSSVSNYSSPIKLMFLSEVKSSEGVKYTLTSVGTSHSNVVLPSEKP

SEQ ID NO: 776585 - protein, 190 aa, Homo sapiens
RCARLAGGTVSSRQTPTGPAGMEQPPPLAPEPASARSRRRREPESPPAPIPLFGARTVVQRSPDEPALSKAEFVEKVRQSNQACHDGDFHTAIVLYNEALAVDPQNCILYSNRSAAYMKTQQYHKALDDAIKARLLNPKWPKAYFRQGVALQYLGRHADALAAFASGLAQDPKSLQLLVGMVEAAMKSPM

SEQ ID NO: 776586 - protein, 79 aa, Homo sapiens
SKVCLNDPFKEFCQLVRFVLFLLLWMDEKAVIKPSLKNQRQRQDSYILNSLFWILGGCKNIKSYIAFSTVEKYNLTKAP

SEQ ID NO: 776587 - protein, 213 aa, Homo sapiens
AVAAALAEVRARTWKMLLAPQGRSFSKKRMGLNRWKRFTRKPSPKPTFGPDSVEHWIKRVEKASEFAVSNAFFTRNSDLPRSPWGQITDLKTSEQIEDHDEIYAEAQELVNDWLDTKLKQELASEEEGDAKNTVSSVTIMPGANGHLKYDKFDDLCGYLEEEEESTTVQKFIDHLLHKNVVDSAMMEDLGRKENQDKKQQKDPRLTMEMRHKQ

SEQ ID NO: 776588 - protein, 111 aa, Homo sapiens
HGNNDHHTSLYCVFCYSNHTPPSRTGMNRYYSERGTRPRPTAGLTILSACPSSQWMSNSWLNPSAMESWLALGRGEAGGWLGPGLDQGGWGPRFPPCIRSWHRDCPHCTDR

SEQ ID NO: 776589 - protein, 90 aa, Homo sapiens
ADVACSYEGQSVGPMDSGDREVALAASAWHCPGRGSPAANMTILPAGGACPGVVLAAICPAQHLLVVIVCSTLEALPVHWGSHVPSHWVI

SEQ ID NO: 776590 - protein, 64 aa, Homo sapiens
MRGARPGPSPGYVIPGPTGRLCIQSCLCGTLKRDVLHSPSVVFNTTRGGTAEWSREGKRSQERL

SEQ ID NO: 776591 - protein, 38 aa, Homo sapiens
WVHWSSRGALVIWAEPTSLRLGTHPQDRHLLELSGSLD

SEQ ID NO: 776592 - protein, 44 aa, Homo sapiens
PTSHWALRVVWGAMGRLQLYGSQPATQRKPAHFPFSSPAEMLTP

SEQ ID NO: 776593 - protein, 129 aa, Homo sapiens
AVPSNGDQSPTPPTSSFSCFTLLHHPPPNFIVFSSLKTSLDMHKTKFLFWGPVNTYSDFFLVPRLTPFSGKPSYFVSSEHFLAGAPAKWGEFHWSTPPNFWERVHSHQPILSAFPSLGLSYLWKSFRDF

SEQ ID NO: 776594 - protein, 77 aa, Homo sapiens
PPFSALSHGTLFHPGFLLSTSSTRVSHGALFLHLGFILSSSSSYVSSSELLLPRECPMGLLLPPCVILRHSFTCVPH

SEQ ID NO: 776595 - protein, 92 aa, Homo sapiens
GGQPGVVVVESVAPVGSGLSPGTAFGSPSIGTIPTLGPKVAMLLWICFPSRGSSACPLPAHSMAWEQLRLGASSSRVDSWKCYQCLLWRLDP

SEQ ID NO: 776596 - protein, 101 aa, Homo sapiens
MLLEREIAALSLAPLLPSVLSTSYLSSVYIILQVSCSTVVALLGTPVMWFKVGASQSERYSFFHPEHLHNVPWANSLNRLFPTFYSCKIAVIRVFFSLIYH

SEQ ID NO: 776597 - protein, 111 aa, Homo sapiens
RTSSQVSSGCQLSSVPCDCRTEISVFLLAVSQGPLAAPRGLPCSHCMLPPASRGGSPCMETLLHFTSLQEVLSPSKELTFTRSSSSDNLSILNLTDLGSRLHLLTCFCHKL

SEQ ID NO: 776598 - protein, 150 aa, Homo sapiens
KDSALGDSNGEKGRNKQKDGEKATTSDLGEPGAGILQPQCTWKITLIAMWRVNCGRTPVEAGRLNQKTVTVVQIRDAYVINRHVKKMLCFPFAFCHDCEFREASTAMLPVLQNCLRLDITSSEQSSLMTQLLYISGWNPPLCSNESVAVC

SEQ ID NO: 776599 - protein, 260 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKEVNLAAAVIAVLGLAVMALGCLCIIMVLSKGAEFLLRVGAVCFGLSGLLLLVSLEVFRHSVRALLQRVSPEPPPAPRLTYEYSWSLGCGVGAGLILLLGAGCFLLLTLPSWPWGSLCPKRGHRAT

SEQ ID NO: 776600 - protein, 119 aa, Homo sapiens
GPRRPGSSPLRSKILEANCTYFKFFTTGENARIFQRTTKKGLLLLVSLEVFRHSVRALLQRVSPEPPPAPRLTYEYSWSLGCGVGAGLILLLGAGCFLLLTLPSWPWGSLCPKRGHRAT

SEQ ID NO: 776601 - protein, 211 aa, Homo sapiens
FKQVAEMLSASRYPTISMVKPLLHMLLNTTLNIKETDSKELSMAKEVIAKELSKTYQETPEIDMFLNVATFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTAT

SEQ ID NO: 776602 - protein, 143 aa, Homo sapiens
VAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKL

SEQ ID NO: 776603 - protein, 156 aa, Homo sapiens
VTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRP

SEQ ID NO: 776604 - protein, 233 aa, Homo sapiens
MVSDKCHILDLIKAQRRQMLILPEGFREGSWSTLLFRATHHLALHPFLGLFGALSPTQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 776605 - protein, 233 aa, Homo sapiens; identical to SEQ ID NO: 776604

SEQ ID NO: 776606 - protein, 292 aa, Homo sapiens
EEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 776607 - protein, 239 aa, Homo sapiens
MAEQGPSSLFLQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 776608 - protein, 108 aa, Homo sapiens
MPTSARLYYRSAECKSVRMRWAAGGRLVAPEVGPVREFLGPDFPAVPPPGISSYVLGCHEGHYSLNWTPGAGILSQCISQRRTLMAAGGTSWTRCLGHAAPVTEDLCG

SEQ ID NO: 776609 - protein, 233 aa, Homo sapiens; identical to SEQ ID NO: 776604

SEQ ID NO: 776610 - protein, 306 aa, Homo sapiens
DKCHILDLIKAQRRQMLILPEGFREGSWSTLLFRATHHLALHPFLGLFGALSPTQWQAISLTVIEKVQIAAIVLGSLFLVASISWLIWSSLSPSAKWQRQDLLFQICYGMYGFMDVVCIGEGTSLSFTCSVSSSYTPNSPAHPLSFLALFSATVAFSAILVPPQPTSLLLQGPLQLYLLTLKKCLLKYLWPRSRPQLTLDFYSYCSGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHS

SEQ ID NO: 776611 - protein, 44 aa, Homo sapiens
TRPSPAVESGRERRGRRARARVWCASEGGGGGGGGGVWGPPPPP

SEQ ID NO: 776612 - protein, 118 aa, Homo sapiens
CWDYKCEPPHPASFSSKSTSYISCVVPSSSKLKSSMTENCPSSAPMMWRGFVSSPNGVGSECVLEASGPPCGLLEMRVSLPQGTDPRNPQVPQRKDLKLLRGTQMLPDLCLGGAAPNR

SEQ ID NO: 776613 - protein, 340 aa, Homo sapiens
WCLCLQNTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKLVTNGTWKIIDRKKSTYLGWPTGEYIALKKDGKFLHAKWSLCSGEAKKKRSIPCHGDRSAHQSGPTERNARREHVKNPNGQKPRHRETAYYTGQRT

SEQ ID NO: 776614 - protein, 108 aa, Homo sapiens
FVGTWGLTMLPRLVSNFWAQAIHPPWPGVFAKSMSSLPLCREQAWALSVGIQGFTGCLCVREAAISAHGLPRGAESAGRLRWSWAFPSVPSLQRHELPPVLGCSLRLL

SEQ ID NO: 776615 - protein, 115 aa, Homo sapiens
FQTEPTACSRRQLRTGEATVTPCGSFHPAVGRVLRPRGERETSKHSLERKAGRAPPASHAPLLALPDAICVFSFPCPRPLPKAIGSMAKIPLWGRKKQRRRHELLISKDRQIAGG

SEQ ID NO: 776616 - protein, 105 aa, Homo sapiens
LMRKKCQRQVCMIVVKTAVQRTVRSWKDSRDRQTVSIDPKAQNRTGNNVGWFWGLFLRQGLTVWAQLECSGRIMAQCSLDLLGLGDPPTSDSRVTETTGMCHAQL

SEQ ID NO: 776617 - protein, 181 aa, Homo sapiens
MPGQSPRMCQASPAASTVPDVGICAHPGHILRGRGCLAVSKTEGPWFPQNITNELLRIEPEKTRSTAEGEAFIQALPGSGTTPLLRTQVEDTNRKYEHLLQLLDLAQEKVDVANRLEKSLQQSWELLATHENHLNQDDTVPESSRVLDSKGQELAVSLGPKSWESFSEQVRASGTSTRPSG

SEQ ID NO: 776618 - protein, 1756 aa, Homo sapiens [sequence omitted]

SEQ ID NO: 776619 - protein, 1255 aa, Homo sapiens
MPGQSPRMCQASPAASTVPDVGICAHPGHILRGRGCLAVSKTEGPWFPQNITNELLRIEPEKTRSTAEGEAFIQALPGSGTTPLLRTQVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRSSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERENLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECDWEEISVKGPNGESSVIHDRKSGKKFSIEEALQSGRLTPAQYDRYVNKDMSIQELAVLVSGQK

SEQ ID NO: 776620 - protein, 1621 aa, Homo sapiens
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTQVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRSSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSEWNMFVKLRSQECDWEEISVKGPNGESSVIHDRKSGKKFSIEEALQSGRLTPAQYDRYVNKDMSIQELAVLVSGQK

SEQ ID NO: 776621 - protein, 1756 aa, Homo sapiens [sequence omitted]

SEQ ID NO: 776622 - protein, 682 aa, Homo sapiens
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTQVEDTNRKYEHLLQLLDLAQEKVDVANRLEKSLQQSWELLATHENHLNQDDTVPESSRVLDSKGQELAVSLGPKSWESFSEQVRASGTSTRPSG

SEQ ID NO: 776623 - protein, 38 aa, Homo sapiens
AKFTEVYAINRQRLQNLEFALNLLRQVTDLSKKFYFRL

SEQ ID NO: 776624 - protein, 1756 aa, Homo sapiens [sequence omitted]

SEQ ID NO: 776625 - protein, 1636 aa, Homo sapiens
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTQVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRSSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERENLQLETRRLQSEINMAATETRDLRNMTVADSGTNHDSRLWSLERELDDLKRLSKDKDLELFHG

SEQ ID NO: 776626 - protein, 102 aa, Homo sapiens
GYITSNGIAELNGSPILSSLRNLQTTFHRGSINLHLHQQCISVPFSLQPCQHLLLVDFLVIAILTGVRWYLIVVFIYISLVISDVEHCSCLLAAFHGLLALC

SEQ ID NO: 776627 - protein, 1224 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 776628 - protein, 1208 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPSQRSRLLRCHLLRSHLPPHLTLQILQPHHSPKQQPQLLGLWTHARVSVLHPYPRPQMAPLAPLQVSAVTLTAKGTAARMVSTTHSRMMGTRVQMRTAALSTAPAPRPPPTRRRPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 776629 - protein, 1078 aa, Homo sapiens
MTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 776630 - protein, 1067 aa, Homo sapiens
MTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRTPSAHPFLLPSPFPFSSAA

SEQ ID NO: 776631 - protein, 1025 aa, Homo sapiens
MTLPNCNYWRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 776632 - protein, 291 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTL

SEQ ID NO: 776633 - protein, 101 aa, Homo sapiens
MLLRFNTTNSSYRKATVNIALFLDKTYPWPGSCGVVHAMALGHVGEMEEGRGPGLRVPKASGYSLVFPTHSVATRGSVALSPGVAHPCGFFTLGKLAGFYA

SEQ ID NO: 776634 - protein, 1265 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDGVSLLLPSLGYNGAILAHCNLRLPGSSDCAASASQVVGITDDVFLPKDIDLDSVDMDETEREVEYFKRFCLDSARQTRQRLSINWSNFSLKKATFAAH

SEQ ID NO: 776635 - protein, 1078 aa, Homo sapiens; identical to SEQ ID NO: 776629

SEQ ID NO: 776636 - protein, 1078 aa, Homo sapiens; identical to SEQ ID NO: 776629

SEQ ID NO: 776637 - protein, 1084 aa, Homo sapiens
MTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDEIIENSRDLLQDVYNICCPLFLGFSRPLQELELRVGVTLGYFLGVTN

SEQ ID NO: 776638 - protein, 33 aa, Homo sapiens
MRFCSDPDCEGHRCENGVYDPQQDDGDESADED

SEQ ID NO: 776639 - protein, 117 aa, Homo sapiens
WKAGDASPLVLLQPRGTLFPYHSCPVPTYSLPVSLEESECLGSQRQRALLSQRGLKIMCRASAWQLGFRHSNRSAKKADSAEYSFSQHSLGCHPQFQELHPTQLPTPCKTAPLSQHL

SEQ ID NO: 776640 - protein, 103 aa, Homo sapiens
DEVSLLPRMENSGVISAHCYLHLLGLSDSPASASRVAGITDVYHHTRLILVFLVETGFRHVGQAGLELLISGNLPASASQCAEITGMNHHAWPIVILKFNFNW

SEQ ID NO: 776641 - protein, 189 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 776642 - protein, 197 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCETGVHQGLFFCCK

SEQ ID NO: 776643 - protein, 189 aa, Homo sapiens; identical to SEQ ID NO: 776641

SEQ ID NO: 776644 - protein, 193 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCCPFADQALF

SEQ ID NO: 776645 - protein, 176 aa, Homo sapiens
ATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQ

SEQ ID NO: 776646 - protein, 38 aa, Homo sapiens
MTDPRGCKRLPPGLNSGHLGMATPSPGISVGSAKILVA

SEQ ID NO: 776647 - protein, 79 aa, Homo sapiens
MRSLFCPCMTELARGLIAKDRSLLKLPPRGRCGVKLGQVLEKERLHHLALVKCSLRLAWEPLRPSTGKIQRLLSAQASL

SEQ ID NO: 776648 - protein, 220 aa, Homo sapiens
QHPGVKVARLTRDDQLGPRELKKYRLITKQGILLVRFNASALLAGLGARLAALRTSGTFSPLPTEAVSEAGGDVARLLLSPSVQRDVLPGGTIIQDWQPYRPSESNLRLLAAKGLEWRVDSRARPRVLTLCTRPFPIPHGGDGTWRYLNIDAFGSDGAQVQSQLLWHLQRQAPRLVGLNVMCQLFLEPQLWSQLADFCQVGLGLELVKGYTEQYLLEADI

SEQ ID NO: 776649 - protein, 111 aa, Homo sapiens
AKALDSGAFFSFVVLSPSFPLPSCPHHFTLLKVIMNTRSEIPFLAPSTLGFFEMESHCVTQAVARICPLQPPSPWLKQFSCLSLLSSWDYRCKPRHLANFSVFSRDGVSPC

SEQ ID NO: 776650 - protein, 84 aa, Homo sapiens
MSGVMRFPSTQHPARRAAHRRRGHGQSNGGQARAGAAAAGTAPYHSPVLFTKQELLESISVNKLSWTFYQSLYLFLDDSLRTLI

SEQ ID NO: 776651 - protein, 351 aa, Homo sapiens
YSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGIQTQTQLEPNWGAARRANPPDGRGWVSSSLTLKVTSALSRDGISCEASKPHGNKAPCLPLRQREAPDSQAGVAVMAVAASGGLLLLGGAASNWVNAKGPLCRGGKGARRGPGGI

SEQ ID NO: 776652 - protein, 116 aa, Homo sapiens
MHLNISTVVMIGSSKVSMAPVPKPDSLLEVIRGKNAILSWLWPNHTSFSSPSAVDMYLGQQAKWKLGVPSCFGAALLSVWHVYSVGCSLQCILCVLWKRKHSGKKVVKLHLQHALF

SEQ ID NO: 776653 - protein, 694 aa, Homo sapiens
IRTHTSSWQRSAQDGSWGARADLGGWEPGDRMAPKRVVQLSLKMPTHAVCVVGVEAHVDIHSDVPKGANSFRVSGSSGVEVFMVYNRTRVKEPIGKARWPLDTDADMVVSVGTASKELKDFKVRVSYFGEQEDQALGRSVLYLTGVDISLEVDTGRTGKVKRSQGDKKTWRWGPEGYGAILLVNCDRDNHRSAEPDLTHSWLMSLADLQDMSPMLLSCNGPDKLFDSHKLVLNVPFSDSKRVRVFCARGGNSLSDYKQVLGPQCLSYEVERQPGEQEIKFYVEGLTFPDADFLGLVSLSVSLVDPGTLPEVTLFTDTVGFRMAPWIMTPNTQPPEELYVCRVMDTHGSNEKFLEDMSYLTLKANCKLTICPQVENRNDRWIQDEMEFGYIEAPHKSFPVVFDSPRNRGLKDFPYKRILGPDFGYVTREIPLPGPSSLDSFGNLDVSPPVTVGGTEYPLGRILIGSSFPKSGGRQMARAVRNFLKAQQVQAPVELYSDWLSVGHVDEFLTFVPTSDQKGFRLLLASPSACLKLFQEKKEEGYGEAAQFDGLKHQAKRSINEMLADRHLQRDNLHAQKCIDWNRNVLKRELGLAESDIVDIPQLFFLKNFYAEAFFPDMVNMVVLGKYLGIPKPYGPIINGRCCLEEKVQSLLEPLGLHCIFIDDYLSYHELQGEIHCGTNVRRKPFPFKWWNMVP

SEQ ID NO: 776654 - protein, 121 aa, Homo sapiens
LLGPAGGIEPLPSGTHSLMEETEPCPQRAPSLMRETRPHAGAMTYFHRSKSEPLILRSLVKCIDWNRNVLKRELGLAESDIVDIPQLFFLKNFYAEAFFPDMVNMVVLGKYLGIPKPYGPH

SEQ ID NO: 776655 - protein, 33 aa, Homo sapiens
SSHQNGSHLGLSAENCLQPASQPAGEAAAYSQA

SEQ ID NO: 776656 - protein, 52 aa, Homo sapiens
EDVCPLTPGPGKALGQQHHGSLLAAAFKEATNTSHRCPPNLTLLWLACVCTA

SEQ ID NO: 776657 - protein, 102 aa, Homo sapiens
TPSFPWYPHHCHFCCITDIGLQTGVVVTESVSDTPSLLTLQGNLAGRWLESGMKPKGRADRDHLNASTPRDSHRILDTIQKSHPEGDNNITVTHELKRHSLQ

SEQ ID NO: 776658 - protein, 161 aa, Homo sapiens
GGQARGSPWGEQRSVGPQKRLWGSEPPPGAAFQVQQGQSSGGRHLPSWFNTWTPDPGKGTEPGEASGHCTMKLWGAAGASGLRAGQAQRGDHVLRGRSVPGWTSQCTRRNMQRLSQPREAAERVRGGRRREGACAVCSLEGGSMCRVFTEKEESMRCVFSD

SEQ ID NO: 776659 - protein, 118 aa, Homo sapiens
MRCSVATQNEPWTHTARRMNMQTSGHVKGARPRGATLCDSGWSLCAQDPAASSSSWLQGVLVSEERQAGVPRGRLEGLRNHFHLLSPPCLHCLGKKARSQRAQRGSEEARVPWRDAAS

SEQ ID NO: 776660 - protein, 150 aa, Homo sapiens
GGQARGSPWGEQRSVGPQKRLWGSEPPPGAAFQVQQGQSSGGRHLPSWFNTWTPDPGKGTEPGEASGHCTMKLWGAAGASGLRAGQAQRGDHVLRGRSVPGWTSQCTRRNMQRLSQPREAAERVRGGRRRSSRIPGGSARPFRRQVPGQY

SEQ ID NO: 776661 - protein, 217 aa, Homo sapiens
MRCSVATQNEPWTHTARRMNMQTSGHVKGARPRGATLCDSGWSLCAQDPAASSSSWLQGVLVSEERQAGVPRGRLEGLRNHFHLLSPPCLHCLGLYPPVSLLHGKEMERHVNHHCWGSSMGPQGTHGFPRRKLCHWTAGLRLLHRPLPALSPGLRESGKGGVQLHCEWTKATDLHTCQWLKWSIKRHVPFATGKKARSQRAQRGSEEARVPWRDAAS

SEQ ID NO: 776662 - protein, 141 aa, Homo sapiens
ERSNRENICSAVNQSNVGLGESAAAAVAAALAASSELGVGGGGGGGGKIKRVEGAVSLGAGQKIFFRVSSSRPPVSQPRHLRPLAPQPRQECGLIRVQCLLKETSSALCNAPKPLLRQEGEDHADLTSFGSHQFYAPLEPA

SEQ ID NO: 776663 - protein, 51 aa, Homo sapiens
MSTNTCLLPELPSLQQVAQEGPYKVLPILTTKDVYRRGPSGRLKTQHGARA

SEQ ID NO: 776664 - protein, 73 aa, Homo sapiens
CLPPTAQKKIYLRCTDKETTAQAKCQKSLIASDGARMRLHILLHTLCCLPSRGLSSAIISSHITTKGIQNLAS

SEQ ID NO: 776665 - protein, 230 aa, Homo sapiens
YSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLITTTEMPFTTSVFQIYNVQRTPLMDNWYSLSYLYFSTVGTLV

SEQ ID NO: 776666 - protein, 923 aa, Homo sapiens
HLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSS

SEQ ID NO: 776667 - protein, 603 aa, Homo sapiens
MLIHRHTPLSINFLTDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSS

SEQ ID NO: 776668 - protein, 366 aa, Homo sapiens
MEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSS

SEQ ID NO: 776669 - protein, 270 aa, Homo sapiens
MARFALTVVRHGETRFNKEKIIQGQGVDEPLSETGFKQAAAAGIFLNNVKFTHAFSSDLMRTKQTMHGILERSKFCKDMTVKYDSRLRERKYGVVEGKALSELRAMAKAAREECPVFTPPGGETLDQVKMRGIDFFEFLCQLILKEADQKEQFSQGSPSNCLETSLAEIFPLGKNHSSKVNSDSGIPGLAASVLVVSHGAYMRSLFDYFLTDLKCSLPATLSRSELMSVTPNTGMSLFIINFEEGREVKPTVQCICMNLQDHLNGLTETR

SEQ ID NO: 776670 - protein, 270 aa, Homo sapiens; identical to SEQ ID NO: 776669

SEQ ID NO: 776671 - protein, 300 aa, Homo sapiens
QRVLFPPQARVHLRPLARTVQLRQLLAGHVPSRSWSKSVPRGETRFNKEKIIQGQGVDEPLSETGFKQAAAAGIFLNNVKFTHAFSSDLMRTKQTMHGILERSKFCKDMTVKYDSRLRERKYGVVEGKALSELRAMAKAAREECPVFTPPGGETLDQVKMRGIDFFEFLCQLILKEADQKEQFSQGSPSNCLETSLAEIFPLGKNHSSKVNSDSGIPGLAASVLVVSHGAYMRSLFDYFLTDLKCSLPATLSRSELMSVTPNTGMSLFIINFEEGREVKPTVQCICMNLQDHLNGLTETR

SEQ ID NO: 776672 - protein, 74 aa, Homo sapiens
AILGAFVTSPHVPSLVPTLSSFDSLPHYSEEFRGHVFCAWYMLVCNEIDTYLSHQKPAFCCHFQKFRKAICFNH

SEQ ID NO: 776673 - protein, 270 aa, Homo sapiens
MRAAVAASVGLSEGPAGSRSGRLFRPPSPAPAAPGARLLRLPGSGAVQAASPERAGWTEALRAAVAELRAGAVVAVPTDTLYGLACAASCSAALRAVYRLKGRSEAKPLAVCLGRVADVYRYCRVRVPEGLLKDLLPGPVTLVMERSEELNKDLNPFTPLVGIRIPDHAFMQDLAQMFEGPLALTSANLSSQASSLNVEEFQDLWPQLSLVIDGGQIGDGQSPECRLGSTVVDLSVPGKFGIIRPGCALESTTAILQQKYGLLPSHASYL

SEQ ID NO: 776674 - protein, 440 aa, Homo sapiens
LFRVQPPALGRERSQGILLGDGQGSAAPSPASFGKPPLAETAGWGGAPGLAETFPPQPAPAPRPAAVTSPRSCDGVQELPLPLLHRVQQLSGALLPAAVGGGLPPSPSPAFPRSTPAASRSPSILLGVVVPLSCPAQRRGRVSWTGSWLGASLPPGSGPGRMSPARRCRGMRAAVAASVGLSEGPAGSRSGRLFRPPSPAPAAPGARLLRLPGSGAVQAASPERAGWTEALRAAVAELRAGAVVAVPTDTLYGLACAASCSAALRAVYRLKGRSEAKPLAVCLGRVADVYRYCRVRVPEGLLKDLLPGPVTLVMERSEELNKDLNPFTPLVGIRIPDHAFMQDLAQMFEGPLALTSANLSSQASSLNVEEFQDLWPQLSLVIDGGQIGDGQSPECRLGSTVVDLSVPGKFGIIRPGCALESTTAILQQKYGLLPSHASYL

SEQ ID NO: 776675 - protein, 270 aa, Homo sapiens; identical to SEQ ID NO: 776673

SEQ ID NO: 776676 - protein, 270 aa, Homo sapiens; identical to SEQ ID NO: 776673

SEQ ID NO: 776677 - protein, 270 aa, Homo sapiens; identical to SEQ ID NO: 776673

SEQ ID NO: 776678 - protein, 270 aa, Homo sapiens; identical to SEQ ID NO: 776673

SEQ ID NO: 776679 - protein, 270 aa, Homo sapiens; identical to SEQ ID NO: 776673

SEQ ID NO: 776680 - protein, 89 aa, Homo sapiens
LFTLWVRTAFMSCNTQTAKVCGFTPEVSETMNPPAGRNWTHLKKQTPDTPSLRAVTLTAKVRDFILEVSETKNPQEGINSRHTTTVPVH

SEQ ID NO: 776681 - protein, 319 aa, Homo sapiens
EGGSSRARVSTSRRLGVCSLFLLPGSTEGNGDLSEEKMPLLTLYLLLFWLSGYSIATQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPT

SEQ ID NO: 776682 - protein, 247 aa, Homo sapiens
MWLPQLDLMRVISAKSQGYSIATQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNSSRVSPEQVLQPLEGDLCYADLTLQLAGTSPQKATTKLSSAQVDQVEVEYVTMASLPKEDISYASLTLGAEDQEPTYCNMGHLSSHLPGRGPEEPT

SEQ ID NO: 776683 - protein, 41 aa, Homo sapiens
MAQSQRPSAAGSARGPGGALELAGEPQEVLAFAACPAPPSF

SEQ ID NO: 776684 - protein, 106 aa, Homo sapiens [sequence omitted]

SEQ ID NO: 776685 - protein, 90 aa, Homo sapiens
LACIYEALILHDDEVTVTEDKINALIKAAGVNIEPFVTWLVCKGLVNVNIGSLICSVEAGGAAPAEEKKVEAKKEESEDGDDDMRFGLFH

SEQ ID NO: 776686 - protein, 165 aa, Homo sapiens
CGRGWWGGRKLLVELQHPSVSGPWEGEGKEPGLSCGVKGSHFSPPTATSVLTAHGSPESRGLVGLGIHNAGYFHPDVLCHHRPGHSVLHYLSALVAWSCGRSLLENSSEGRMELNGRVPCLLTHRWIFASAVISAPGLSSPTRGLSSTEAVLLPSRPLSEPSRHG

SEQ ID NO: 776687 - protein, 172 aa, Homo sapiens
EKPYKCEECGKAFSIFSTLTKHKIIHTEEKSHRCEECGKAYKESSHVTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPY

SEQ ID NO: 776688 - protein, 114 aa, Homo sapiens
LSSIGLFLSYILYNKLVKCKKSVFLSPLRSSSELSNLRRRSWETPNLQSRWTKVQVVWGPGTYNRALKSVESEANSEKLVSKLNGIVGHSTGVGEPENTSSEGNKSISLQNMLL

SEQ ID NO: 776689 - protein, 67 aa, Homo sapiens
KYRESPAEFSIWTREAGAGGLSIAVEGPSKAEITFDDHKNGSCGVSYIAPGSLAFVFGASQEDIFLV

SEQ ID NO: 776690 - protein, 302 aa, Homo sapiens
PGLLRCGLEGWARGRRRSRQLETMVDHLANTEINSQRIAAVESCFGASGQPLALPGRVLLGEGVLTKECRKKAKPRIFFLFNDILVYGSIVLNKRKYRSQHIIPLEEVTLELLPETLQAKNRWMIKTAKKSFVVSAASATERQEWISHIEECVRRQLRATGRPPSTEHAAPWIPDKATDICMRCTQTRFSALTRRHHCRKCGFVVCAECSRQRFLLPRLSPKPVRVCSLCYRELAAQQRQEEAEEQGAGSPGQPAHLARPICGASSGDDDDSDEDKEGSRDGDWPSSVEFYASGVAWSAFHS

SEQ ID NO: 776691 - protein, 378 aa, Homo sapiens
PTVPRPGCGSRGRRMRRVSHHHPRTSELSPAARSWRLLGRRGAVPLTPAQEEAWEGRSWAACGVNLQGAWGERSGVRASEAESPGKRADVSWWSRQLETMVDHLANTEINSQRIAAVESCFGASGQPLALPGRVLLGEGVLTKECRKKAKPRIFFLFNDILVYGSIVLNKRKYRSQHIIPLEEVTLELLPETLQAKNRWMIKTAKKSFVVSAASATERQEWISHIEECVRRQLRATGRPPSTEHAAPWIPDKATDICMRCTQTRFSALTRRHHCRKCGFVVCAECSRQRFLLPRLSPKPVRVCSLCYRELAAQQRQEEAEEQGAGSPGQPAHLARPICGASSGDDDDSDEDKEGSRDGDWPSSVEFYASGVAWSAFHS

SEQ ID NO: 776692 - protein, 279 aa, Homo sapiens
MVDHLANTEINSQRIAAVESCFGASGQPLALPGRVLLGEGVLTKECRKKAKPRIFFLFNDILVYGSIVLNKRKYRSQHIIPLEEVTLELLPETLQAKNRWMIKTAKKSFVVSAASATERQEWISHIEECVRRQLRATGRPPSTEHAAPWIPDKATDICMRCTQTRFSALTRRHHCRKCGFVVCAECSRQRFLLPRLSPKPVRVCSLCYRELAAQQRQEEAEEQGAGSPGQPAHLARPICGASSGDDDDSDEDKEGSRDGDWPSSVEFYASGVAWSAFHS

SEQ ID NO: 776693 - protein, 898 aa, Homo sapiens
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 776694 - protein, 898 aa, Homo sapiens; identical to SEQ ID NO: 776693

SEQ ID NO: 776695 - protein, 743 aa, Homo sapiens
MDIIAQVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 776696 - protein, 898 aa, Homo sapiens; identical to SEQ ID NO: 776693

SEQ ID NO: 776697 - protein, 562 aa, Homo sapiens
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKKESLLLLPKLECSGTTSAHCNLCLPDSSNSPASASQLAGITSVHHYAQLIFVFLVEMMFHNVGHASLELLTSGDPSASASQSAGITG

SEQ ID NO: 776698 - protein, 194 aa, Homo sapiens
SSPSPPASPPAPPVNPHRRAPPELERWGPCVARGAELGVTSQASCPAGARGWALGKPVRPPRLRCQCLTFWSDPPPWCLPAKGDRRLHFHRLPRRGAQLRDVHHGWAPRGERRPTPAVPARNGEGFRGVRRRTLGPPAAVYRASHLLSVFPLSRSKNTKLGTPGCPPTPAPWPYPHLHPHPRIAIFRGGLGRGC

SEQ ID NO: 776699 - protein, 54 aa, Homo sapiens
YAGFSQVCWVLLGVLGPPGCAGSFLSVLGPSRVCWVLSGVLGPPGCAGSSWVCW

SEQ ID NO: 776700 - protein, 108 aa, Homo sapiens
MRRMCSSRTGAGTKCLFFHQHERLPSASLLPSPLLSHSVQWRSTIHTAVGGEIVGFGVNTPAVQSQLCGPGWESQFTSLSLSCPICRMGPTAGTGMTLSSCLLYPKCP

SEQ ID NO: 776701 - protein, 106 aa, Homo sapiens
SESSPSSSEDEEEVVAREEEEEEEEEEMVAEESMASAGPEDFEQDGEEAALAPGAPAVDSLGMEEEVDIETEAVALRSGPPCWTSPPCLWVLKSQRTPGSRLRNQA

SEQ ID NO: 776702 - protein, 137 aa, Homo sapiens
NLGRILRPGKCLGVAGVALPGGIWDVRKEDVLDQTKASSRQGGRAGSERAGQAWRHPEHSRLQGLVLAPGKGIFVLFVSLSTLADWHPCLQPEGPHVGSIEPVLPALGAAGLNPQPGTFYAYRVPGPRPTPPEWERS

SEQ ID NO: 776703 - protein, 91 aa, Homo sapiens
EAEEEITGLEESKIQEKEWKEQGSKDLGGFMIKSKGEGHDLARRRDIHFILEPKIERQNTIYSLKEFRGEEKGSTKKNTSNGSSFLRKVAN

SEQ ID NO: 776704 - protein, 160 aa, Homo sapiens
RGWGSSRWLWCPWGWEHEWARMMVRQRRRPRGSARLRGGGPRGPGSGRHRGPWKRQGWGRGDACLEHGDPSPAPTCRPGPRAAGRVAGGPGCPGGGPGPGPRPGARSGVRVARPSRGGTDRRREEGKPPGLKILSLRSHSEVHAAFMSCNTHREDLQLHS

SEQ ID NO: 776705 - protein, 109 aa, Homo sapiens
PRLGEQPLALVPLGVGARVGKDDGEAEEAAPRERPAERRGAEGPGERASPRALEAAGLGERRRVSGAWGPQPSSHLQTWAAGCRPSGRGAWLPRRRAGAGAAAGGAERS

SEQ ID NO: 776706 - protein, 109 aa, Homo sapiens; identical to SEQ ID NO: 776705

SEQ ID NO: 776707 - protein, 109 aa, Homo sapiens; identical to SEQ ID NO: 776705

SEQ ID NO: 776708 - protein, 30 aa, Homo sapiens
MSPSYSWQLTSQLVHCDITARSTNINDTKE

SEQ ID NO: 776709 - protein, 110 aa, Homo sapiens
MRKNFGVRAELCEGLLGWGISSYGPHAIYLLLERGDFEWVGMDRCSSRKPCWLMGTTSVYYCDSLCKLPMWPRTPLLPGHFLPPHCTGLNHSACCCCTMLGCGRIGKGFC

SEQ ID NO: 776710 - protein, 87 aa, Homo sapiens
AEVKVLADTQSSRSSVQCGFPWAEVKVLADTQSSRSSVQCGFPWAEVKVLADTQSSRSSVQCGFPWAEVKVLADTQSSRSSVQCGFP

SEQ ID NO: 776711 - protein, 45 aa, Homo sapiens
MTLRSVLSHVQIAARMTGNEALSDSPFLWVTRDHYSLNTLNGSQV

SEQ ID NO: 776712 - protein, 55 aa, Homo sapiens
EETEARAVVHPGVLVPSSVNKGDWKPQEARKDRLSSPCVMVQSLVWALGGFGGAG

SEQ ID NO: 776713 - protein, 52 aa, Homo sapiens
WGQAQATHPDLRSSGIHHADPQCQNLPAWALKGSWASKGRGTTRVVPASTHR

SEQ ID NO: 776714 - protein, 263 aa, Homo sapiens
PCCRPFASFTAADPFKFYMRECVSIHVGQAGVQIGNVCWELYCLEHGIQPDGQMPSDKTIGGGDDSFNTFSETGAGKHVPRAVFVDLGNQQVLGVSFGDVRHYMRRRLFTTRATLSSHGADAGWSTNKYARGHYTIGKEIIDLVLDRIRKLANQCTGFQGFLVFHSFGGGTGSGFTSLLIERLLVDYGKKSKLEFSNYPAPQVSTAVVEPYNSILTTHTTLEHSDCAFMVDNEAICDICCRNLNIERPTYTNLNHLISQIVSS

SEQ ID NO: 776715 - protein, 77 aa, Homo sapiens
VRASLCHASHWVAGASFSEGTHSHPSKSSLSFWPKLARNRDLGWVLETPQCLAPHSTGTAGPTWAALLGKQEQQKLR

SEQ ID NO: 776716 - protein, 267 aa, Homo sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 776717 - protein, 73 aa, Homo sapiens
DANQGCAPAPGITGRRTPSSRGPQQNVQKHPRIDQFIHSTNEYLMEEAPDGGKSQCNASKWRHGVLMEKQQDL

SEQ ID NO: 776718 - protein, 267 aa, Homo sapiens; identical to SEQ ID NO: 776716

SEQ ID NO: 776719 - protein, 218 aa, Homo sapiens [sequence omitted]

SEQ ID NO: 776720 - protein, 159 aa, Homo sapiens
GLKFHIGINRYELYSRHNPAIEALLHDLSSQRITSVADFTGTSCMSDPLSGWWGVEDEFSLNEICCLCGPDSPRKRHTRTVPNPEEERALQSRARQPGRVERRGLHWEGLRTFHRVCRAAYLPGGSVLAGRGMREPCTPARAFGRSSTQVRKSPVPLSV

SEQ ID NO: 776721 - protein, 48 aa, Homo sapiens
KNSAPFNRQKHKEFSDIKLSGKNTHEAEVLLSPKKVMAREEMEKLNSK

SEQ ID NO: 776722 - protein, 39 aa, Homo sapiens
ISGRKGRGMGTGLTATRQKELSSRDGNIIHQSVMMAACL

SEQ ID NO: 776723 - protein, 53 aa, Homo sapiens
EIKEMVHEQKAPPQSLSFPLQPNPPAVPDSNAQPPNCLRTQQLMSLHAGGRSQ

SEQ ID NO: 776724 - protein, 92 aa, Homo sapiens
MATPPSGVLLQLDSSSEEQTHSVTAQQGQQREPPNQLLPPDPSTAGTQDALNQPPLLDSSTVGTQDTLNQLSLPDSSKVRTQDTLNQPLLTD

SEQ ID NO: 776725 - protein, 596 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVNLLEQELQELRAQAALARDMGPPTFPEDVPALQRELERLRAELREERQGHDQMSSGFQHERLVWKEEKEKVIQYQKQLQQSYVAMYQRNQRLEKALQQLARGDSAGEPLEVDLEGADIPYEDIIATEI

SEQ ID NO: 776726 - protein, 560 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVKRLRAELREERQGHDQMSSGFQHERLVWKEEKEKVIQYQKQLQQSYVAMYQRNQRLEKALQQLARGDSAGEPLEVDLEGADIPYEDIIATEI

SEQ ID NO: 776727 - protein, 487 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQPELRGHVPAEPAPGEGPAAAGTWGQRRGALGG

SEQ ID NO: 776728 - protein, 573 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVNLLEQELQELRAQAALARDMGPPTFPEDVPALQRELERLVWKEEKEKVIQYQKQLQQSYVAMYQRNQRLEKALQQLARGDSAGEPLEVDLEGADIPYEDIIATEI

SEQ ID NO: 776729 - protein, 573 aa, Homo sapiens; identical to SEQ ID NO: 776728

SEQ ID NO: 776730 - protein, 573 aa, Homo sapiens; identical to SEQ ID NO: 776728

SEQ ID NO: 776731 - protein, 442 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKSYEREKTSFGPALEETQWEVRPHRAHGFGWSAVWRQYPPLLLVPANSVQTQTAQASGANVLALSPKEGAPCKPCWGIDLHLSFLLSPPSPSWLLDFSFPSEPLNHEAGSQMTKAQPGCGLTSLP

SEQ ID NO: 776732 - protein, 573 aa, Homo sapiens; identical to SEQ ID NO: 776728

SEQ ID NO: 776733 - protein, 520 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVRAARVEGGEGEGDSVPETAAAELRGHVPAEPAPGEGPAAAGTWGQRRGALGG

SEQ ID NO: 776734 - protein, 205 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHTPGSPWRLTWKGLTSPTRTS

SEQ ID NO: 776735 - protein, 133 aa, Homo sapiens
MGSVSSLISGHSFHSKHCRASQYKLRKSSHLKKLNRYSDGLLRFGFSQDSGHGKPDQMSSGFQHERLVWKEEKEKVIQYQKQLQQSYVAMYQRNQRLEKALQQLARGDSAGEPLEVDLEGADIPYEDIIATEI

SEQ ID NO: 776736 - protein, 573 aa, Homo sapiens; identical to SEQ ID NO: 776728

SEQ ID NO: 776737 - protein, 131 aa, Homo sapiens
SNRLSMPPPPSPKVGGSLQGDTVCRDLGFRTRLEDEALQILDRPLDDPLATTPPRRGGASQGALPESPWSPVQRGSSPSGTHAPTTSPLPFLLLPVTIQVLGSMAHPHCCPCSSSSQPFAPPVSTQPVSFF

SEQ ID NO: 776738 - protein, 109 aa, Homo sapiens
APGLVRGLAALGPSPNESAAPLRLRIQRKSLLLPLKGWSLSKRFLPFLHRPDRRVLVCALPRADWDSPPTRSLFLKSLSFPHLPRKLSTFGLSAPPKLPRIPGPLTVLP

SEQ ID NO: 776739 - protein, 104 aa, Homo sapiens
PPACWLTPDTAALCFLPPGQLVPGSCSGGSCSGVSPEGSGGETEIPMLSLTMPRPRANLQMKTQPRPVRWLTSVIPALWEAETRGSQGQEFKTSLAKIVKPRLY

SEQ ID NO: 776740 - protein, 232 aa, Homo sapiens
ASGCRGRPKAGSRTCERRDGAGGRAEGSRGIREMGGSPAGRGPRASPGGTRRHPPAPDASRDPALPWGKVRSGLVPAPWTGLRLCFSCLSLLLSLLLLSLYASLSSSGSFILSLFFLSPFLSLLLSFASPPGLSFLPCVCLPLPTACSGSPSVSLLCPFILFPLSLSHNLLVSLSLSRGFRSRSSWLPCLLLSAPISLLVPLSVQAPCFRLCLAVLEKSLWKLSAVVRVLLL

SEQ ID NO: 776741 - protein, 220 aa, Homo sapiens
GKRFRLGTKAADGGGGGGGGWVGPRRAAAAEVEAEGGGGGGGGKMAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSLYLAYILYFVLKEFCIICIVTYVLNFLLLIINYKRLVYLNEAWKRQLQPKQD

SEQ ID NO: 776742 - protein, 101 aa, Homo sapiens
SLRLFSYRHDSKRCGGFDPHDVLHHVGRGVPVPGLHSHHLHRHVRAELPSSHYQLQTTSLLERAATQAGLTPDRLHPNSLKPLSIQFILQQIIIIHNRHFP

SEQ ID NO: 776743 - protein, 220 aa, Homo sapiens; identical to SEQ ID NO: 776741

SEQ ID NO: 776744 - protein, 219 aa, Homo sapiens
GKRFRLGTKAADGGGGGGGGWVGPRRAAAAEVEAEGGGGGGGGKMAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSLYLAYILYFVLKEFCQAKSIMMEKTSPSPIAPEWEPVFLLIVSFCTNHSDV

SEQ ID NO: 776745 - protein, 220 aa, Homo sapiens; identical to SEQ ID NO: 776741

SEQ ID NO: 776746 - protein, 117 aa, Homo sapiens
GKRFRLGTKAADGGGGGGGGWVGPRRAAAAEVEAEGGGGGGGGKMAAPVLLRVSVPRWERVARYAVCAAGILLSIYAYHVEREKERDPEHRALCDLGPWVKCSAALASSKFNTQQLP

SEQ ID NO: 776747 - protein, 117 aa, Homo sapiens; identical to SEQ ID NO: 776746

SEQ ID NO: 776748 - protein, 67 aa, Homo sapiens
SLGLPHVLSPSRNQALPALPTACVDTAPQMPSASLTFPETLSERLGQNLSLEFCCPQIHPPTLEAGR

SEQ ID NO: 776749 - protein, 64 aa, Homo sapiens
MCPVGARVLCVSSCMHKHAHPFLFLCTHKPMYSAVIISTRASVPMPLHMCIPGMCTQRCASTPV

SEQ ID NO: 776750 - protein, 211 aa, Homo sapiens
AGSLRVQAGLSSAGPALGNSGLAALMASPSKAVIVPGNGGGDVTTHGWYGWVKKELEKIPGFQCLAKNMPDPITARESIWLPFMETELHCDEKTIIIGHSSGAIAAMRYAETHRVYAIVLVSAYTSDLGDENERASGYFTRPWQWEKIKANCPYIVQFGSTDDPFLPWKEQQEVADRLETKLHKFTDCGHFQNTEFHELITVVKSLLKVPA

SEQ ID NO: 776751 - protein, 128 aa, Homo sapiens
METELHCDEKTIIIGHSSGAIAAMRYAETHRVYAIVLVSAYTSDLGDENERASGYFTRPWQWEKIKANCPYIVQFGSTDDPFLPWKEQQEVADRLETKLHKFTDCGHFQNTEFHELITVVKSLLKVPA

SEQ ID NO: 776752 - protein, 211 aa, Homo sapiens; identical to SEQ ID NO: 776750

SEQ ID NO: 776753 - protein, 211 aa, Homo sapiens; identical to SEQ ID NO: 776750

SEQ ID NO: 776754 - protein, 93 aa, Homo sapiens
AGSLRVQAGLSSAGPALGNSGLAALMASPSKAVIVPGNGGGDVTTHGWYGWVKKELEKIPGFQCLAKNMPDPMSHHARPLILLYPPDYLNLLH

SEQ ID NO: 776755 - protein, 78 aa, Homo sapiens
LRVQAGLSSAGPALGNSGLAALMASPSKAVIVPGNGGGDVTTHGWYGWVKKELEKVSAQRRCSVKSAWREGRRERTEG

SEQ ID NO: 776756 - protein, 116 aa, Homo sapiens
MHTHLWFWTTDVDVPGTTWTGAIADRPEDLLGLIDLKASLGSGSYRDLVAALSHRAKTDGARNTPFLQHRSRNRYLRTLFTPQLVSLTHMGARPSARQRIQVSRLQIRAGCSGSCL

SEQ ID NO: 776757 - protein, 47 aa, Homo sapiens
MSSAREASNCDAGGMVVTGGRLGVIFLEEPGMVAHTYNPGTLGSRGG

SEQ ID NO: 776758 - protein, 113 aa, Homo sapiens
RRQQEAQNPSWVSCLESQGVAMLKFAVPLLPMGIRIRSRTSIGKGGQFVTEETRTDPEQRRQRRAGLMKRDKGPDPSSAWLVGLGVWFSLRDHRDKPGRPKRSRVQIPDEPTL

SEQ ID NO: 776759 - protein, 104 aa, Homo sapiens [sequence omitted]

SEQ ID NO: 776760 - protein, 105 aa, Homo sapiens
FLVLIIFIVAHFRQIRNSREPPVLHTTQYEKQSYKCYGKYFLKTSMDLKRGLHWRVHLLCQRWKPFAALGLPPNTTHPAGWPGLTWSPSSTLELDNETGPTVRSK

SEQ ID NO: 776761 - protein, 77 aa, Homo sapiens
MKPYLGSSGEGSKEEGNTDAFIVVSVPELVLSFSHKMSHQDALKLFNPKRIPGSHPYSVSHGQLHRKCGSEGTQPHC

SEQ ID NO: 776762 - protein, 506 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKVTALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 776763 - protein, 295 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGAVHRALRESSRV

SEQ ID NO: 776764 - protein, 155 aa, Homo sapiens
RKQCFKTAKWILRYHSFLLLNPRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEV

SEQ ID NO: 776765 - protein, 541 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 776766 - protein, 541 aa, Homo sapiens; identical to SEQ ID NO: 776765

SEQ ID NO: 776767 - protein, 484 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELYTCVSHNHSHCDFSGVSIR

SEQ ID NO: 776768 - protein, 503 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLGVSIR

SEQ ID NO: 776769 - protein, 503 aa, Homo sapiens; identical to SEQ ID NO: 776768

SEQ ID NO: 776770 - protein, 471 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLWTVWK

SEQ ID NO: 776771 - protein, 406 aa, Homo sapiens [sequence omitted]

SEQ ID NO: 776772 - protein, 388 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRESLSKGGNIMEQNFEV

SEQ ID NO: 776773 - protein, 151 aa, Homo sapiens
PVPTTGILFSNRPCWWTLRNFALGALKKFGLGTRTVEARVLEEAACLLDEFQATIASAWPGERKGLVWESPLHCQDGATGRYLGGRKPVSPWGWLGAGPRVMTTVLFLPPGAPFDPVRLLDNAVSNVICSCLREPLSLWGPGVPEAPEPLQ

SEQ ID NO: 776774 - protein, 132 aa, Homo sapiens
AGGPRGRAAWGSPSSGCSQTWRCSGSTSERRRGPVRQGGLPGPEHLKKTAMKPHTQVPGAEAKGSWGQERLISLRVEQQRAQDRTACPAAGGGQGPTLAGAHRVQRTRSSPLLQQEEGSGGTPLLGLEAGID

SEQ ID NO: 776775 - protein, 335 aa, Homo sapiens
GGTVRNVGIMAHHLPAAMESHQDFRSIKAKFQASQPEPSDLPKKPPKPEFGKLKKFSQPELSEHPKKAPLPEFGAVSLKPPPPEVTDLPKKPPPPEVTDLPKKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRSPQPELSTFPKKPAQPEFNVYPKKPPQPQVGGLPKKSVPQPEFSEAAQTPLWKPQSSEPKRDSSAFPKKASQPPLSDFPKKPPQPELGDLTRTSSEPEVSVLPKRPRPAEFKALSKKPPQPEL

SEQ ID NO: 776776 - protein, 126 aa, Homo sapiens
LTLWLQSVQDRAWYTLDAQQLRLFSFPSVVPARRSPGLTGESSWLPRKPAQNNNWEHKLLENTRPWKKITLLKCQSGDKKWSKILAQRWCGGICLPRPLTWGRCSVQGRHLCFRTRPALEKSRWGT

SEQ ID NO: 776777 - protein, 93 aa, Homo sapiens
GCGEGKGAHAVPGESRCGSHAGWTSPQRCWDPGTLSRLESSRLKGENGGSLQKNQKTKNVCWRKTRSAVGILYHQARDGIGLCASECVHICQF

SEQ ID NO: 776778 - protein, 151 aa, Homo sapiens
WPWQFLPFLGAFLFWAPPFRKRAPEHVEGVAAEPEAGTLSGSGFFPGPLPAVRVLCPLHPECVLNPEGGVRAHPALLCVCVCVCVCVCVCVFLRQGLALLPRLECIGTISARCSLCLPGSSNSPASASQVAGTTDGCPHTPLIFIFLVETG

SEQ ID NO: 776779 - protein, 99 aa, Homo sapiens
ETKVSSLEGMGAAGAGGGAATVLVTEPRVLQVKGKASTLHSNPGKHLLQRDASRFLLSLWVSFVATSLQHPFFPEFLSGRSMHLRGLRSSDAQVLQEIH

SEQ ID NO: 776780 - protein, 193 aa, Homo sapiens
GKARSRGGVEPAGPGGGSPEPYHPTLGIYARCIRNPGVQHFQRDTLCGPYAESFGEIASGFWQATAIFLAVGIFILCMVALVSVFTMCVQSIMKKSIFNVCGLLQGIAGLFLILGLILYPAGWGCQKAIDYCGHYASAYKPGDCSLGWAFYTAIGGTVLTFICAVFSAQAEIATSSDKVQEEIEEGKNLICLL

SEQ ID NO: 776781 - protein, 79 aa, Homo sapiens
RPAPLSPHWTVQVGGISDTNQIFGLSETEPGSFLYYAPFDGILGLAYPSISSSGATPVFDNIWNQGLVSQDLFSVYLSA

SEQ ID NO: 776782 - protein, 388 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776783 - protein, 330 aa, Homo sapiens
DLSTRCKNSPGELLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776784 - protein, 296 aa, Homo sapiens
VSWLSRGHCVVSEDACHAAGTVGDGDCLAGGLVEWKTPQGMKRLWLVQARLEQQTEGHPQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776785 - protein, 266 aa, Homo sapiens
MNQGGSGPEAGIQSSVNMTRGEHHLGFPTQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776786 - protein, 38 aa, Homo sapiens
HNLNPARKYFPQWEAPTLVDEQPLENYLDVSVRASGGA

SEQ ID NO: 776787 - protein, 68 aa, Homo sapiens
VAVVYHIPRKAAGAKMNPPFDGILGLAYPSISSSGATPVFDNIWNQGLVSQDLFSVYLSARDWGPAHA

SEQ ID NO: 776788 - protein, 349 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQRGYQLESYMY

SEQ ID NO: 776789 - protein, 282 aa, Homo sapiens
TYTNSSSNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776790 - protein, 282 aa, Homo sapiens
RLLMAEQLTTMSPSEFSLAPMTLWMLAMGLVGPGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 776791 - protein, 684 aa, Homo sapiens
MQSREDVPRSRRLASPRGGRRPKRISKPSVSAFFTGPEELKDTAHSAALLAQLKSFYDARLLCDVTIEVVTPGSGPGTGRLFSCNRNVLAAACPYFKSMFTGGMYESQQASVTMHDVDAESFEVLVDYCYTGRVSLSEANVQRLYAASDMLQLEYVREACASFLARRLDLTNCTAILKFADAFDHHKLRSQAQSYIAHNFKQLSRMGSIREETLADLTLAQLLAVLRLDSLDIESERTVCHVAVQWLEAAAKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCYDPYSGDIYTMPSPLTSFAHTKTVTSSAVCVSPDHDIYLAAQPRKDLWVYKPAQNSWQQLADRLLCREGMDVAYLNGYIYILGGRDPITGVKLKEVECYSVQRNQWALVAPVPHSFYSFELIVVQNYLYAVNSKRMLCYDPSHNMWLNCASLKRSDFQEACVFNDEIYCICDIPVMKVYNPARGEWRRISNIPLDSETHNYQIVNHDQKLLLITSTTPQWKKNRVTVYEYDTREDQWINIGTMLGLLQFDSGFICLCARVYPSCLEPGQSFITEEDDARSESSTEWDLDGFSELDSESGSSSSFSDDEVWVQVAPQRNAQDQQGSL

SEQ ID NO: 776792 - protein, 684 aa, Homo sapiens; identical to SEQ ID NO: 776791

SEQ ID NO: 776793 - protein, 171 aa, Homo sapiens
PPPPPPPPAPRPRAWRGSRRRSRPGSRPQTRRSCSGDLDGSGDPGGLGDWLLEVEFGQGPTGCSHVESFKVGKNWQKNLRLIYQRFVWSGTPETRKRKAKSCICHVCSTHMNRLHSCLSCVFFGCFTEKHIHKHAETKQHHLAVDLYHGVIYCFMCKDYVYDKDIEQIAKE

SEQ ID NO: 776794 - protein, 164 aa, Homo sapiens
LGNLGRSCLHTHTATHTCTQVLGKPSKILSRHTHTHTHTPHTPHTHNHTHTTSPLSPIPRATQQLYCVSLKSETQRSNADGAATAYMQMSLLITQVALSYNIIFTPLLLHRGYHFHAVSLKCPTRGVTYCSGYVHLVLTIFHSSPSYERRIDELVDDIYYFPIY

SEQ ID NO: 776795 - protein, 69 aa, Homo sapiens
DIKFSPFLLSIYYVLALKSSWIHKKKAAFSSKSPLWPHLSLNDSGPSISTSPGNRTGDNDSKPQIKPHV

SEQ ID NO: 776796 - protein, 174 aa, Homo sapiens
HKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLI

SEQ ID NO: 776797 - protein, 106 aa, Homo sapiens
MKRPSPGLPLSPFPSPLHSWSTSWKNTSWGAAFPSKRWGLHSQPAIRKLNRSSPRSRVSTGRARVDQLCSSGTNPPYMPGLEAFGFVDAKSGWSRLLHPDSPASPF

SEQ ID NO: 776798 - protein, 106 aa, Homo sapiens; identical to SEQ ID NO: 776797

SEQ ID NO: 776799 - protein, 106 aa, Homo sapiens; identical to SEQ ID NO: 776797

SEQ ID NO: 776800 - protein, 85 aa, Homo sapiens
KRAEDCMGTVHGLSLEVMYITSTSNSIHILLAETLKERLGNVVQLHVEGESEQALVTTQPSLLRYPRRQIEEPVHAFNMLAPRPP

SEQ ID NO: 776801 - protein, 140 aa, Homo sapiens
AGVEGVGVWDIESTPESKLSLLGKSGAAPPPPAPGAPKAPGCGNSSVFRRPGLMGTVKVRLVWKVGRIPEEWRSRGAGGGGWGPRSGGVSTPALGVLALRWRLRTAVRWMTGEALMGLKLAGRKPKSGEGEGDGAGEKGD

SEQ ID NO: 776802 - protein, 36 aa, Homo sapiens
QQDWLACVTRESSWPKVEKNHQMWGYEPKAANGITN

SEQ ID NO: 776803 - protein, 230 aa, Homo sapiens
MKAEVTLDGVWPTDKTSRRLIKSPDRLADINYEGRLEAVSRKQGAQFKEYRPETGSWVFKVSHFSKYGLQDSDEEEEEHPSKTSDKEVEDCSFASCKPDYALARWLFNGKAAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLG

SEQ ID NO: 776804 - protein, 917 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHRPDDMQAHPGSTLSLGLRPALVPAFSPVRTVSLRLAVFCVPLSEGAAYTYHSDASRVSPGPWPGWGWGHRSAQSRRRPGFLGSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776805 - protein, 387 aa, Homo sapiens
MQAHPGSTLSLGLRPALVPAFSPVRTVSLRLAVFCVPLSEGAAYTYHSDASRVSPGPWPGWGWGHRSAQSRRRPGFLGSVLSSQFLALCTLKPSLVVELARDLLEFLGSVNGLCSRASLVTSVVRRALASHSRFLTQEAWVGAESLSPGLGVGHRRVPVGDLRSEVHRGADQQVLRSPGGSAIRGHPVPPLCCPAQVSPPGGHRADDHADEAGLPEPRSDPQVPGQGGSEAFWLLGKRGGFLRSSHPGVVKWSQQRRSWVGPAELKPLCWAFRPGPSTQTPVLGGEHLQLTEGPSFPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776806 - protein, 218 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRVTETRRSEPWARACYERWRAGSLRDPASDTSSPSWPRPGHPAQQAAGRLAALRQPPARAPTLRRLLLHAQGPAAGPRHRGGRGGSHRLLHGALQRPPLHRRPVAERAGLLYAAGVAAAQRPRGPGHPGHR

SEQ ID NO: 776807 - protein, 835 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776808 - protein, 651 aa, Homo sapiens
MAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776809 - protein, 911 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEGTRGPSQEAVGVCLPRSFPEGPWWVGSVGGRWGTRGGPRVWDAAGFCFLRKVGQHPNNPGICEDSTSPPHATPPTADQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776810 - protein, 824 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKTRPPCSASGWSTGCATPASSKGSHTPAASSPRPGPGSRAPSPRWTGLVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776811 - protein, 559 aa, Homo sapiens
MRAYWLARPGWRLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 776812 - protein, 835 aa, Homo sapiens; identical to SEQ ID NO: 776807

SEQ ID NO: 776813 - protein, 685 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVRRALASHSRS

SEQ ID NO: 776814 - protein, 262 aa, Homo sapiens
PEVDRGAELLGCSSWSFRGSCASGGGGVMFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVEREAGLMPG

SEQ ID NO: 776815 - protein, 128 aa, Homo sapiens
MCHSVCDSRAVRVPGRGRPSAASPASQREDASEPLVSWRAGLRLRAPNQSQKHGQGEVKTCALAGPGLAGEAAAVDSEAVYQHLFTRIPVEQFHSPMLAFEFIQFCRDNLHLFSGHLSTLRLSFPNLF

SEQ ID NO: 776816 - protein, 396 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 776817 - protein, 84 aa, Homo sapiens
LASTRLGSNRPRVEQVANAAFTCVSLRPSCAKNCVRRIGCLPWLSSARSTECELVPRQPAGLPDPIQPGDRRPLLNSSILLGTG

SEQ ID NO: 776818 - protein, 353 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 776819 - protein, 396 aa, Homo sapiens; identical to SEQ ID NO: 776816

SEQ ID NO: 776820 - protein, 396 aa, Homo sapiens; identical to SEQ ID NO: 776816

SEQ ID NO: 776821 - protein, 292 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQAILALMEVKMKEMKGSIRHLRLTEAKLREELREKDRLLAMAVIRKKHGM

SEQ ID NO: 776822 - protein, 379 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRRGMSRDYRFGKTIP

SEQ ID NO: 776823 - protein, 415 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELRESQDRVGRGVLVGSGWERLCEGGWGCFGFPNKETGV

SEQ ID NO: 776824 - protein, 246 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQANH

SEQ ID NO: 776825 - protein, 314 aa, Homo sapiens
MPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 776826 - protein, 396 aa, Homo sapiens; identical to SEQ ID NO: 776816

SEQ ID NO: 776827 - protein, 373 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRRQAARRTA

SEQ ID NO: 776828 - protein, 396 aa, Homo sapiens; identical to SEQ ID NO: 776816

SEQ ID NO: 776829 - protein, 369 aa, Homo sapiens
AASPGPTPERRRAARRAARRGPAGSVFWARGAGRAGCAERQWWDTTQGLARRRPSRGGRRRSHWAVEERRRPVGRAGPRGAAMPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRPSAS

SEQ ID NO: 776830 - protein, 224 aa, Homo sapiens
MNLGGKRTPTITPGCVGSTHTTVGVQQQSPPHQDNRTHPDPRQREKKKETRTKTARRQKRAATPHQGRVTKHGHRAPWGTTLAVTTSAGPAMTRAQHNLLYPPRGAPSQQNNTIQMKTEPLMRPQAKGPSGDARVETNARGMNTPTNSVPRRGGVPRRTPTRRGAHRHKNSIERGRGSMAMERMNDSSMTDKPPRAAPRGTTAADSHGQHHQAQLTPRRPHDHS

SEQ ID NO: 776831 - protein, 78 aa, Homo sapiens
VSALWCRYLSSRPPLDQASEPVGCQGRTVPHRRHGSPHAIHQVSPGSIQVTGLEGPQQPSWTCSLWGSSFSGTNSRTQ

SEQ ID NO: 776832 - protein, 725 aa, Homo sapiens
SSYHSSTCFSIFQCGAVCAQPCPPGTFGQNCSQDCPCHHGGQCDHVTGQCHCTAGYMGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLLDQCPGGQVPARGLLH

SEQ ID NO: 776833 - protein, 880 aa, Homo sapiens
SSYHSSTCFSIFQCGAVCAQPCPPGTFGQNCSQDCPCHHGGQCDHVTGQCHCTAGYMGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLLISALEARYPPEDFYIELRHLSRPAEPHSPGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 776834 - protein, 330 aa, Homo sapiens
TLSGIMLLLFLIVVLLGLFACDSTHRVPLCTQCWADLGVGIQLLHHEGSLVTPDSFEARAAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLLISALEARYPPEDFYIELRHLSRPAEPHSPGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 776835 - protein, 152 aa, Homo sapiens
SRRGQTGPELRGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 776836 - protein, 1021 aa, Homo sapiens
PLPAARLPAARGPLLLPGALARLGLRRTGPRDWPADPWAGRGSSYAVTVQESYAHPFDQIYYTRCTDILNWFKAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 776837 - protein, 669 aa, Homo sapiens
MGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLLDQCPGGQVPARGLLH

SEQ ID NO: 776838 - protein, 725 aa, Homo sapiens; identical to SEQ ID NO: 776832

SEQ ID NO: 776839 - protein, 725 aa, Homo sapiens; identical to SEQ ID NO: 776832

SEQ ID NO: 776840 - protein, 92 aa, Homo sapiens
RYLEEQEDSKMVDLFVGQMKSYLKCQACGYHSMTFKVFFFCDLSLTIPKKGFAGGKVSLRDCLSLFTKEEELELENASVCDPHGQKTHGAKS

SEQ ID NO: 776841 - protein, 68 aa, Homo sapiens
LHHLPAGRERGEEGEHAYDTLSLESSDSMETSISTGGKLGQPTLVFSWTDPKFRTSPFFNSSFPMICS

SEQ ID NO: 776842 - protein, 147 aa, Homo sapiens
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 776843 - protein, 112 aa, Homo sapiens
TSSTPPRASNPKTPHPLSQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 776844 - protein, 147 aa, Homo sapiens; identical to SEQ ID NO: 776842

SEQ ID NO: 776845 - protein, 147 aa, Homo sapiens; identical to SEQ ID NO: 776842

SEQ ID NO: 776846 - protein, 111 aa, Homo sapiens
PTIFFFPTPYIPNTPPSQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 776847 - protein, 487 aa, Homo sapiens
MRRGERRDAGGPRPESPVPAGRASLEEPPDGPSAGQATGPGEGRRSTESEVYDDGTNTFFWRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 776848 - protein, 116 aa, Homo sapiens
MRRGERRDAGGPRPESPVPAGRASLEEPPDGPSAGQATGPGEGRRSTESEVYDDGTNTFFWRAHTLTVLFILTCTLGYVTLLEETPQDTAYNTKRFVSTGRQARPWVCPLPEFHGF

SEQ ID NO: 776849 - protein, 431 aa, Homo sapiens
MSDLRRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 776850 - protein, 219 aa, Homo sapiens
QGSVGCLPQAAGSVVPRGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 776851 - protein, 487 aa, Homo sapiens; identical to SEQ ID NO: 776847

SEQ ID NO: 776852 - protein, 524 aa, Homo sapiens
MRRGERRDAGGPRPESPVPAGRASLEEPPDGPSAGQATGPGEGRRSTESEVYDDGTNTFFCCDPGLALCQMLLCEKDQAVDLKAGFVRGGFGIFLTARRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 776853 - protein, 487 aa, Homo sapiens; identical to SEQ ID NO: 776847

SEQ ID NO: 776854 - protein, 84 aa, Homo sapiens
GSLRVEAGLQPASLAGRVRHHPGGKAGLPRDGAAGGGPELVLTLSSPEFLLAELNTFYLKFVLWMPPEHYLVLLRLVFFVNVGG

SEQ ID NO: 776855 - protein, 306 aa, Homo sapiens
DYFRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPLNTTRINAAEIESRVRELSKLAETTDKVKQGFWEEFETLQQRSANFSTAKEVKARKHKRKKTGINAGGRNRGNEGHGKGPGQFLSQGRLRPKERLIRTGTVKPHEQRKTPTVHIQKRTTHSTPKTRENHIYMH

SEQ ID NO: 776856 - protein, 77 aa, Homo sapiens
VTRDGSCVRAGGCVGLQEKMAVSTGVKVPRNFRLLEELEEGQKGVGDGTVSWGLEDDEDMTLTRWTGMIMWATKDKL

SEQ ID NO: 776857 - protein, 73 aa, Homo sapiens
RIQRPLNSENGLQEKMAVSTGVKVPRNFRLLEELEEGQKGVGDGTVSWGLEDDEDMTLTRWTGMIMWATKDKL

SEQ ID NO: 776858 - protein, 81 aa, Homo sapiens
VTRDGSCVRAGGCVGLQEKMAVSTGVKVPRNFRLLEELEEGQKGVGDGTVSWGLEDDEDMTLTRWTGMIMWATKAGIIEEG

SEQ ID NO: 776859 - protein, 77 aa, Homo sapiens; identical to SEQ ID NO: 776856

SEQ ID NO: 776860 - protein, 110 aa, Homo sapiens
SDARRFVRACGRLRRAAGEDGGLHRLVCNGVILAHRNLHLPGSSDSPASASRVAGIPGVKVPRNFRLLEELEEGQKGVGDGTVSWGLEDDEDMTLTRWTGMIMWATKDKL

SEQ ID NO: 776861 - protein, 81 aa, Homo sapiens; identical to SEQ ID NO: 776858

SEQ ID NO: 776862 - protein, 95 aa, Homo sapiens
RCYTMRWGRKDREDSPRETWSYVCNLRAIVRDHVVGSVANLDLVKAVPVELAGVVRVELESLVVAYWGHRVVDLSEEEIRSELLISDYSPREDKL

SEQ ID NO: 776863 - protein, 81 aa, Homo sapiens
AEDTDGGPGTQRNNSNLMVIAWLLELSLKAIDRWLGYWIQEAGRRVEIQDVLNKFPRGGLRRESLAASMTNYENRIYSLKG

SEQ ID NO: 776864 - protein, 107 aa, Homo sapiens
MFKCLCISHTIPPSGEKIPPFLTVTHTNSQAWVKTFDPGDHSWSHAHSSSLTLIIWLPPPFYGFPGGQPRRTAHTQWAGQPIFFSSLAKGALGPILKHLNLGGYSGK

SEQ ID NO: 776865 - protein, 85 aa, Homo sapiens
GSIRGGAQNTGGYGEDGHFLLFLMQRWVIDLDSIGLTYSAVKAGTATVLSIAEPLLESIVRVWNDSRQVVTIASESRGTSKAATR

SEQ ID NO: 776866 - protein, 77 aa, Homo sapiens; identical to SEQ ID NO: 776856

SEQ ID NO: 776867 - protein, 112 aa, Homo sapiens
VTRDGSCVRAGGCVGLQEKMAVSTGVKVPRNFRLLEELEEGQKGVGDGTVSWGLEDDEDMTLTRWTGMIMWATKGGCPEHTSVSKSGKNSYSINTCGTSRAKTSNDVQQNTL

SEQ ID NO: 776868 - protein, 77 aa, Homo sapiens; identical to SEQ ID NO: 776856

SEQ ID NO: 776869 - protein, 127 aa, Homo sapiens
TIPCWHAIPDMSGAHVVISLYPRRILVMTSCLQELLSTENARVDLDSHELLRDGVLVVHNWIYQAVSSMPSRRYRIARPRSRVLAKVAKVHIALTRVVLQELRRLMMSNRTHYEASTGHQKDKHTTN

SEQ ID NO: 776870 - protein, 77 aa, Homo sapiens
QWYQRRVAITAGGVGLQEKMAVSTGVKVPRNFRLLEELEEGQKGVGDGTVSWGLEDDEDMTLTRWTGMIMWATKDKL

SEQ ID NO: 776871 - protein, 77 aa, Homo sapiens; identical to SEQ ID NO: 776856

SEQ ID NO: 776872 - protein, 77 aa, Homo sapiens; identical to SEQ ID NO: 776856

SEQ ID NO: 776873 - protein, 77 aa, Homo sapiens; identical to SEQ ID NO: 776870

SEQ ID NO: 776874 - protein, 77 aa, Homo sapiens; identical to SEQ ID NO: 776870

SEQ ID NO: 776875 - protein, 77 aa, Homo sapiens; identical to SEQ ID NO: 776870

SEQ ID NO: 776876 - protein, 240 aa, Homo sapiens
QTARCHSGLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 776877 - protein, 76 aa, Homo sapiens
MLTPMVAGGVVFPGLFLLSKNTLQRLPQLRWEEADAVIVSARLVSSVQAIMASTAGYIAAARHAAHQQQTQPCSTN

SEQ ID NO: 776878 - protein, 274 aa, Homo sapiens
MTLLFAVGCVFFPLCFTALRWGLQNHTNLQMERQEAVLVASKLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 776879 - protein, 274 aa, Homo sapiens
MLTPMVAGGVVFPGLFLLSKNTLQRLPQLRWEEADAVIVSARLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 776880 - protein, 274 aa, Homo sapiens; identical to SEQ ID NO: 776879

SEQ ID NO: 776881 - protein, 360 aa, Homo sapiens
MTLLFAVGCVFFPLCFTALRWGLQNHTNLQMERQEAVLVASKLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQVSEHGRVQEPNGEVTGRGGTFKVAAKGSSPFVIPPSPRAFGAPGACVLAKCLVWEELPARVAGRQGEGQGGPSPSAAVATVSVSPQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 776882 - protein, 132 aa, Homo sapiens
SDPNHWCPLSSLLPHPVSLPNRHWLSSAYTQFAVPYFIYDIYAMFLCHWHKHQVKGHGGDDGAARAPGSTWAIARGYLHKEFLMVLHHAAMVLVCFPLSVVSPGELGGRGAGGLLLGPAGAGRSLGSPGSAY

SEQ ID NO: 776883 - protein, 320 aa, Homo sapiens
LEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCD

SEQ ID NO: 776884 - protein, 34 aa, Homo sapiens
MRRPEWTNSKQAKIITFKLMNFVRQGKNTPLREL

SEQ ID NO: 776885 - protein, 118 aa, Homo sapiens
MDCRGFGKTKFALCRLGVGAPLLRAYTTEPKKLALEISPFYKLLWLTQLLARGTPPILGRERWGVGMANWLLVPQEIFQLPYCTVTFFGSGPCGVLNWGGPLNLLGRFNTFLMRGCTI

SEQ ID NO: 776886 - protein, 122 aa, Homo sapiens
HQITGEWNPSLVAPTSSSALSDTPIVVSKTYRNIPLGKEPVRLLPGPALCSHCPSLHLSPAAPGAVGLLRCFGFLCILLCIVECIVLLRLCNRAPQAGGVHCRRYLLRVLEAENSRSRCGKG

SEQ ID NO: 776887 - protein, 128 aa, Homo sapiens
MAGNHCELLPLARGRLGAGLGWLLVPPLKRGAQRPGPAPQQQVQVGPALQRRHLLPHHWADAAVSGPEILPVPLEPGRPRPGLGQDGVLFLLPKLEYNGTILAHHNLCHLGSSESPPSVSCNASYLGG

SEQ ID NO: 776888 - protein, 120 aa, Homo sapiens
MAGNHCELLPLARGRLGAGLGWLLVPPLKRGAQRPGPAPQQQVQVGPALQRRHLLPHHWADAAVSGPEILPVPLEPGRPRPGLGQDGVLFLLPKLEYNGTILAHHNLCHLGSSESPPSVS

SEQ ID NO: 776889 - protein, 129 aa, Homo sapiens
MSLPVTSACNLDNNQAVPQSPWAHVLRTSQDYVTGHGPHIWLRINLFEYLTEFGFFINSAITSELGFQGWSGKILSLGAGNRGCRGTLRPVWQERFPGQPWSSMRFGKQTGRLALNGGRCSDWISGFWG

SEQ ID NO: 776890 - protein, 139 aa, Homo sapiens
HPLPVLCASPNPCSVHPRPMLSASSPPLLSASPPQALCIPAPCSVHPLSMLCASSPCSVHPLSVLCASSPHALCILSPCSCILPVLRASSLRALCILSPCSVHLPMLCASLMLCASSPPCSVPLPVLCASSLCSVHPLP

SEQ ID NO: 776891 - protein, 218 aa, Homo sapiens
SALADLESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWILPACR

SEQ ID NO: 776892 - protein, 187 aa, Homo sapiens
SALADLESIRQCGVALCIVLGFSILSASIGSSVLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWILPACR

SEQ ID NO: 776893 - protein, 256 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 776894 - protein, 256 aa, Homo sapiens; identical to SEQ ID NO: 776893

SEQ ID NO: 776895 - protein, 256 aa, Homo sapiens; identical to SEQ ID NO: 776893

SEQ ID NO: 776896 - protein, 167 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNMPPPMHTSSSTPLMRTGTGPSTLRTLWLASPSCCGAQSTRSSSGPLISTTLTRMATSPKRRCWPS

SEQ ID NO: 776897 - protein, 324 aa, Homo sapiens
PPRLEVCRLTRKVALGLGRRVRSPRPASGLTRSPPPPPSTGPRPSQPSSPACRGHVSRRRPREAVRAAGAPVPPRQRVGEGCARAPGPQAARLAMGIQGMELCAMAVVVLLFIAVLKQFGILEPISMEDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 776898 - protein, 124 aa, Homo sapiens
MILDCAPQQDGEAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 776899 - protein, 158 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFETGWSAVAPP

SEQ ID NO: 776900 - protein, 96 aa, Homo sapiens
PVPVPCGCHADPQAVFADVVFDFTRLELRLRHFATQGCHDSRPHVPWVAHTLGEREGPGPLPQPNLNPEPPRGERPGMWGWEAPWDQSTSTFGETK

SEQ ID NO: 776901 - protein, 56 aa, Homo sapiens
MRSQSVRRDGNKSLHPKVSPQQAFLSLVDWVFVSQVSDIRRPNTTRGILSVYQGQM

SEQ ID NO: 776902 - protein, 48 aa, Homo sapiens
NGLLRSDLNKLANKEKRNFTKEMSERRPWNETQQGTERKLTQMERKPN

SEQ ID NO: 776903 - protein, 1029 aa, Homo sapiens
MQVTGGVHVDVDSMKEGFVLTVGSPHVGPLTQQAFRPSPQVLSEQPQLSDSSLAWGAQAAEAVEMAAQTSQGPTCAGLASQHHQAGPASQRHQAGPCECPLPDTHLVERLGLGRLLCCTTSHSQEGPRSQRKPVAQWLSGGLHGWQAWAGCWRGIRTGATLLTAPLSELKSLWVGGTSHPCHSWLALECLSPHTPLQPGLWELCLLRYKRLCLFLDLLVLVWASHLPCCEPPRAGTAACHVSLSGTKWTLEAYVEGVRARIGHWACWEPTQAGSPAGGALLLPAPVTPAGSAPTQSPHFCSPGTPCVPTCPCPCPGPAWLLPPSSEEASAGSRPPWTRGQLPPLTWAHPEPSPLNPGEMAFLKAQRACLPQCGSCIRSPPDSDGQEPSVPGGLPNSGPVGGSGQSLVPKGKAVTLGPRWLNPSLPGRAVTSVADKALLLGPLISAEPKLALPVSPEQLAVFTTLQHDSGQARAPLCTSWSPSGHLAGADGHGRVCASMSPQVCELRLPFLLLQCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTGEAPRRLLHATQVWVGGLAARSLGAAGSGHWALTAPDSRALDKLPVDRWTPRSRRQAGDWVEGGAEADPRCTPVWLSQQPRPPVLATLASPPLQGGISLWGSRASRQSRSNQKVGRSQGAWELGACPSDPGARRAPCRVRSYLQAVTAPAMGLSRLARSHSGRGLHNKLRVPDSNCRTGSGHPQTPRLDACAGTLDLVALWAAATAFERVWGAGARPESGPEDSEKHLLMLGPLEEAPSLYSQPAPGGQLRAPGVAQAGWSWAASPALLPGLCPAGCGPEQAREAEGLGSLRQPQPVVSSSLSCPGDTGASWSLGRLGHCGCGRGQVRSPIRAGKTGHLGTHASTEGLAGHRLWAAQEDCAGRAAC

SEQ ID NO: 776904 - protein, 371 aa, Homo sapiens
AAAGQAAAAALGEAAGPGLPDEAGLAGARQLQLQEAAGDPDAPPKKRLRAAEAAEAAAAAAAAGSGKLEERLYSVLCCTVCLDLPKASVYQCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 776905 - protein, 371 aa, Homo sapiens; identical to SEQ ID NO: 776904

SEQ ID NO: 776906 - protein, 274 aa, Homo sapiens
MCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 776907 - protein, 287 aa, Homo sapiens
PGCEIRTCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 776908 - protein, 371 aa, Homo sapiens; identical to SEQ ID NO: 776904

SEQ ID NO: 776909 - protein, 607 aa, Homo sapiens
AAAGQAAAAALGEAAGPGLPDEAGLAGARQLQLQEAAGDPDAPPKKRLRAAEAAEAAAAAAAAGSGKLEERLYSVLCCTVCLDLPKASVYQCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTGEAPRRLLHATQVWVGGLAARSLGAAGSGHWALTAPDSRALDKLPVDRWTPRSRRQAGDWVEGGAEADPRCTPVWLSQQPRPPVLATLASPPLQGGISLWGSRASRQSRSNQKVGRSQGAWELGACPSDPGARRAPCRVRSYLQAVTAPAMGLSRLARSHSGRGLHNKLRVPDSNCRTGSGHPQTPRLDACAGTLDLVALWAAATAFERVGEPGARPESGPEDSEKHLLMLGPLEEAPSLYSQPAPGGQLRAPGVAQAGWSWAASPALLPGLCPAGCGPEQAREAEGLGSLRQPQPVVSSSLSCPGDTGASWSLGRLGHCGCGRGQVRSPIRAGKTGHLGTHASTEGLAGHRLWAAQEDCAGRAAC

SEQ ID NO: 776910 - protein, 371 aa, Homo sapiens; identical to SEQ ID NO: 776904

SEQ ID NO: 776911 - protein, 285 aa, Homo sapiens
MRRAGCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 776912 - protein, 371 aa, Homo sapiens; identical to SEQ ID NO: 776904

SEQ ID NO: 776913 - protein, 107 aa, Homo sapiens
EITYNSLQIKLRLSNRPVFMLSEGRMVSDINNAWGCLEQQEEDCSFLLLKGPYDDVRISPVIYHFVFTNESNETDYVPLPIIDSVECNKLLAAKNINLRLFLFQIQK

SEQ ID NO: 776914 - protein, 107 aa, Homo sapiens
MAWHLRCIKTFMAFHYFPLEASFKTSHICALSIFPGISLKCVCFTTAKLTLPEFPECSFSFVHCATDWNTFFQKPPVHTSLQCQGPNHLHVSQFLPLWESYSSPQTE

SEQ ID NO: 776915 - protein, 43 aa, Homo sapiens
MDACQALFQGMQQKLDPHKSCEAGSAYCPRFLDDTAKAQTSWE

SEQ ID NO: 776916 - protein, 193 aa, Homo sapiens
MAGVWDRWLFARGMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 776917 - protein, 115 aa, Homo sapiens
TRPVLGSRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 776918 - protein, 193 aa, Homo sapiens; identical to SEQ ID NO: 776916

SEQ ID NO: 776919 - protein, 77 aa, Homo sapiens
HAFPSPTQGLAWSTCSLQPRPTGDLTLPSPGTMNAACELLGRLQAEVLECVSLVELTSLKGREKLAPVPFFSLLQYE

SEQ ID NO: 776920 - protein, 86 aa, Homo sapiens
LAPGDSHAAESLLSLTLTGLDSRGFLFGPSLAQELGLGCVLIRKRGKLPGPTLWASYSLEYGKKVRGLGWPEEGQGQATVATLPQF

SEQ ID NO: 776921 - protein, 142 aa, Homo sapiens
MAGVWDRWLFARGMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKLTSLKGREKLAPVPFFSLLQYE

SEQ ID NO: 776922 - protein, 147 aa, Homo sapiens
MAGVWDRWLFARGMADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 776923 - protein, 51 aa, Homo sapiens
IEYSLDSRAVFSIVTGQRGWTSCWLAAGLGEEDPLPCRGFAPLPPSQMQSS

SEQ ID NO: 776924 - protein, 107 aa, Homo sapiens
TPLSPLPDGVPKAELGLCFLPGPPRPPENSPHLSALKAPGDLCLALLCPMIPPPWNSLPDPRLFNSHLSSRDPLEHHLHQEALPGPVSGLTASLGSIRILIPLHYTL

SEQ ID NO: 776925 - protein, 176 aa, Homo sapiens
PRGSEAGGPGRGDPASHTFWKTQGEAGAAFGGKGGTGEPTGHGSSHRIPRPEAGSPHDPPVAPAQSGEMRSCPERALGRQSLRRDRTGLPESQLPAQPHPAAERTEGRAAPGELGSQTPESQRTGPGPATARSGWFHQLLLRSRDVRPRTLSISGFRVSRRPPLGLLTSQRGGDGD

SEQ ID NO: 776926 - protein, 30 aa, Homo sapiens
MGSEGACWPHAGGSDSCPLYPCRTVSVSAH

SEQ ID NO: 776927 - protein, 966 aa, Homo sapiens
EVGLAPSRPAAGMGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPPDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 776928 - protein, 1021 aa, Homo sapiens
GSGPGTFPACRRMGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPPDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 776929 - protein, 367 aa, Homo sapiens
VSHLMLAWLAGPQIGPDELQGLENWGQDPGSLPMPQRPGTRGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 776930 - protein, 138 aa, Homo sapiens [sequence omitted]

SEQ ID NO: 776931 - protein, 966 aa, Homo sapiens; identical to SEQ ID NO: 776927

SEQ ID NO: 776932 - protein, 169 aa, Homo sapiens
EVGLAPSRPAAGMGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTGLATLPCTQGPSGPPVGLGHGIRTPRF

SEQ ID NO: 776933 - protein, 1025 aa, Homo sapiens
EVGLAPSRPAAGMGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPPDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYSFRAVVDTWSDEEMNCSGVCMLAAFACAVSRWLGAKFRAGRETHRPWGPQSTCSSMIRAENMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 776934 - protein, 138 aa, Homo sapiens [sequence omitted]

SEQ ID NO: 776935 - protein, 966 aa, Homo sapiens
GSGPGTFPACRRMGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPPDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 776936 - protein, 86 aa, Homo sapiens
TWVSCWTAQSQHDKSPFLHWFRLQTTAWVSQFHLLGVPSADGSRFLSAGSVRLLVCDPFWDSMESKATLAVGGVSGLLDELSHMAS

SEQ ID NO: 776937 - protein, 284 aa, Homo sapiens
GWALPRSLHLGESWNVDQSSDPIAATAMRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQN

SEQ ID NO: 776938 - protein, 153 aa, Homo sapiens
GWALPRSLHLGESWNVDQSSDPIAATAMRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRGKCLAFCSAVLSRI

SEQ ID NO: 776939 - protein, 49 aa, Homo sapiens
MLNNAQPDQYEAPDKDFMLVSLDLLSGLAEGLGGNIEQLVAQSNILTLM

SEQ ID NO: 776940 - protein, 73 aa, Homo sapiens
PAPVSPDDDGNDNGCHVPTACLHPALCSGLCSHYYYPLHKPERVISPSRVIFLFGKSLSSLLEITKLKVREIQ

SEQ ID NO: 776941 - protein, 47 aa, Homo sapiens
GSFWMLRWEGAGPALGPLVPFRPVTSCPFQAMTVLRRPSSLGNSVLA

SEQ ID NO: 776942 - protein, 633 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRIQIGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLVSITFILSRNN

SEQ ID NO: 776943 - protein, 527 aa, Homo sapiens
SGRPGRYAGSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRIQIGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 776944 - protein, 296 aa, Homo sapiens
SITSISLLGHLLHLYLVTANPISWNQFNEQRRLYWSQLKDILMEQMSYREIEVMLLRILQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 776945 - protein, 702 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRIQIGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 776946 - protein, 158 aa, Homo sapiens
TAKMEEVEGSSQPGQPAPRFRTPWLGREKEERRSKLSGGGGLPGAKRNQGVPGGFGSPPRGRGTARACPCCCWPVAVGLWPTAIFPLNSLQGLGRACHTSALHMSFRGGLWAPPAAAGSAPSSGEKCPLAGRRGGFPPRVGMSQLPHHSPRVPLHAVG

SEQ ID NO: 776947 - protein, 108 aa, Homo sapiens
RSATDYEKCGIEVGGVETLPCHHSCPVDPRASSSCQRQNWRETKIQRQVKSKTGKEGNQSQLPTEMLPVMPTHAQHFDSSTSLFYRQNTEAKRGEKKCPTFDGPGQGD

SEQ ID NO: 776948 - protein, 264 aa, Homo sapiens
EKEETARPGGSHTCKGRGRGGGAGGNSQAWWLTPVKEKEEEETARHSGSSLQRRRRKQPVAVAHACRGGGGDSQAQWLMPVKEEEEEQEEEETARKGGSCRKGGEGRGGGGGNSRKDANSALLSNYEVFQLLTDLKEQRKESGKNKHSSGQQNLNTITYETLKYISKTPCRHQSPEIVREFLTALKSHKLTKAEKLQLVNQQAVTAVEIQLMVEESEERSRRNQIEALLTTVTGILLRAEAEQKTIPPACGNDERTSKKHSGPG

SEQ ID NO: 776949 - protein, 38 aa, Homo sapiens
PSNPFPGACLFQALQWPEVWVGPQWGLGPLRLSKPLPL

SEQ ID NO: 776950 - protein, 89 aa, Homo sapiens
WSPYPRETTKRTFRSPQKPKLRNWACPRASSCEAPWSPPRAPILLLELISSVIYLPPASGGTVSNCPTRNLHTHIQHSACKLPAHLDLE

SEQ ID NO: 776951 - protein, 106 aa, Homo sapiens
NIYFYFREISIVVYIFCYYFHWRKSPQVGHGIVERKCKKIFPLMTKDNPPLHLGVWSTKAAEKEGRQFLLRAKKLLGKKEIKTLTHFGMGLGTPSVCYEQLALVDQ

SEQ ID NO: 776952 - protein, 77 aa, Homo sapiens
LSSSTMIRLGTEEGEESIRFLLLQHSAICPMLPDATVLKVWSLSLAWEHQLPVGTLEMQVLRPHTRLTESETRGGGV

SEQ ID NO: 776953 - protein, 425 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQPIWKPFPNQDSDSVVLSGTDSELHIPRVCEFCQAVFPPSITSRGDFLRHLNSHFNGET

SEQ ID NO: 776954 - protein, 425 aa, Homo sapiens; identical to SEQ ID NO: 776953

SEQ ID NO: 776955 - protein, 425 aa, Homo sapiens; identical to SEQ ID NO: 776953

SEQ ID NO: 776956 - protein, 443 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQMAPCIVHLLSILQQGKQLPIWKPFPNQDSDSVVLSGTDSELHIPRVCEFCQAVFPPSITSRGDFLRHLNSHFNGET

SEQ ID NO: 776957 - protein, 264 aa, Homo sapiens [sequence omitted]

SEQ ID NO: 776958 - protein, 425 aa, Homo sapiens; identical to SEQ ID NO: 776953

SEQ ID NO: 776959 - protein, 395 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQPIWKPFPNQDSDSVVLSGTDSGGVTQVV

SEQ ID NO: 776960 - protein, 119 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVDIASAESSI

SEQ ID NO: 776961 - protein, 87 aa, Homo sapiens
EGRADSRGAAGREAEEQRRQPICSLGRDFVREKPRESFPRSGLLVGWFPGPRCQHSIVGLCPNGFKGGTRPGCFAREMGVEGPAVSR

SEQ ID NO: 776962 - protein, 372 aa, Homo sapiens [sequence omitted]

SEQ ID NO: 776963 - protein, 119 aa, Homo sapiens; identical to SEQ ID NO: 776960

SEQ ID NO: 776964 - protein, 68 aa, Homo sapiens
LEWKNKKWYKNRNENEEEKCKGLVKAAKSMNKWRTQRKGLATRVGKSLGRLAHENLSVIKVSKYDKLN

SEQ ID NO: 776965 - protein, 81 aa, Homo sapiens
LASTRFSCGGQGPECPGLHTFLLWSHSGFNCLLCAEMLGRKEDLLHHWKHQHNCEDPSKLWAILNTVSNQGVIELSSEAEK

SEQ ID NO: 776966 - protein, 427 aa, Homo sapiens
KYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 776967 - protein, 84 aa, Homo sapiens
MQEIHEKVLNEVVGAMMYHTFSLTREDLENFKALRVIVQVGSGYDNVAIKAAGELEIAVCSIPSAAVEETADSTTGHILNLYWG

SEQ ID NO: 776968 - protein, 138 aa, Homo sapiens
EQVFRSEKNPARLASWSRIHITGIPDPRGCPLWSCPCHPESLPWCPVSGYSLVRVLSVSQRGCRDTCQFHTAIWSTCRGPGSPDLAALLRCLFSKLRSQFAPHGPGPTVLVLWVLTLSRAPELSLLALRSFIRNTSLE

SEQ ID NO: 776969 - protein, 95 aa, Homo sapiens
RGKKVIFLKQVGIGLLPVTGSLVLSRVPLRGTHQKSAIATSTKIALSNMKSSNIILMLTLRSSSCGSPAIRKVGFSTPKKRHMKLQSSVRLIRKL

SEQ ID NO: 776970 - protein, 117 aa, Homo sapiens
RICILFRLPFGALPTKSPAMQRFLNTCSLPGTSLALLVGETRARSCVCQLSIHSRPHTGLPSQRAITYSHPSRVVHGRTDKCFNKKCAVWGPYLKYWDQPLHGQCAALITDDPCYRM

SEQ ID NO: 776971 - protein, 31 aa, Homo sapiens
MRPCSLRVNLRQNALPHSVHAKGFSPVWNFW

SEQ ID NO: 776972 - protein, 67 aa, Homo sapiens
CGPHIYMAFAYPPVKPARARLPPQQELLSTPARPYSPAPAPGCSWLSTSSEKPSLIPHTGPGLPGTP

SEQ ID NO: 776973 - protein, 258 aa, Homo sapiens
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 776974 - protein, 258 aa, Homo sapiens; identical to SEQ ID NO: 776973

SEQ ID NO: 776975 - protein, 78 aa, Homo sapiens
FIRSVAGSEPGLRINTMGECGVLCSKIASKLIIGGCTYLVKETQSENSPARTAPDQGLVCLISAASSGVQNLLTTPLG

SEQ ID NO: 776976 - protein, 103 aa, Homo sapiens
QTQGKRLCCFLGEAARPHCEGTCCCCSHVTFVSDLRCRLDLGNGVSCVMPSRSICTTGSARPRTEGLMEDTLQLHPAAGGAWGRLHEGLQRKGMCVVCGLPAG

SEQ ID NO: 776977 - protein, 149 aa, Homo sapiens
MRFPTLPNQLPWNVFHFLGHCLQRSKPPSTQWAEYGSMQRSGPGAVESALHKAPEGLRSRAFLLGPQSSHLKNGSKLSSAMPSVGVMSHQMESRSVTQAEVQWQDLSSLQPPPPSFKRFLCLSLWSSWDYRCPPPHLADFCIFSRDGVS

SEQ ID NO: 776978 - protein, 121 aa, Homo sapiens
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQLKLHLKLLLFRIEVLFF

SEQ ID NO: 776979 - protein, 807 aa, Homo sapiens
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKNCRGPSLIPQIKQEKRDGSTNNDPYVAFRRRTEKMQTRKNRKNDEASYEKMLKLRREFSRAITILEMIKRREKTKRELLHLTLEVVEKRYHLGDYGGEILNEVKISRSEKELYATPATLHNGNHHKVQECKTKHPHHLSLKEEASDVVRQKKKYPKKPKAEALITSQQPTPETLPVINKSDIKQYDFHSSDEDEFPQVLSPVSEPEEENDPDGPCAFRRRAGCQYYAPRLDQANHSCENSELADLDKLRYRHCLTTLTVPRRCIGFARRRIGRGGRVIMDRISTEHDPVLKQIDPEMLNSFSSSSQTIDFSSNFSRTNASSKHCENRLSLSEILSNIRSCRLQCFQPRLLNLQDSDSEECTSRKPGQTVNNKRVSAASVALLNTSKNGISVTGGITEEQFQTHQQQLVQMQRQQLAQLQQKQQSQHSSQQTHPKAQGSSTSDCMSKTLDSASAHFAASAVVSAPVPSRSEVAKEQNTGHNNINGVVQPSGTSKTLYSTNMALSSSPGISAVQLVRTVGHTTTNHLIPALCTSSPQTLPMNNSCLTNAVHLNNVSVVSPVNVHINTRTSAPSPTALKLATVAASMDRVPKVTPSSAISSIARENHEPERLGLNGIAETTVAMEVT

SEQ ID NO: 776980 - protein, 807 aa, Homo sapiens; identical to SEQ ID NO: 776979

SEQ ID NO: 776981 - protein, 807 aa, Homo sapiens; identical to SEQ ID NO: 776979

SEQ ID NO: 776982 - protein, 423 aa, Homo sapiens
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKNCRGPSLIPQIKQEKRDGSTNNDPYVAFRRRTEKMQTRKNRKNDEASYEKMLKLRREFSRAITILEMIKRREKTKRELLHLTLEVVEKRYHLGDYGGEILNEVKISRSEKELYATPATLHNGNHHKVQECKTKHPHHLSLKEEASDVVRQKKKYPKKPKAEALITSQQPTPETLPVINKSDIKQYDFHSSDEDEFPQVIVPKIHYRKKKQLMRLRKQAEKNVEKKIDKYTEVLKTHGLLV

SEQ ID NO: 776983 - protein, 807 aa, Homo sapiens; identical to SEQ ID NO: 776979

SEQ ID NO: 776984 - protein, 807 aa, Homo sapiens; identical to SEQ ID NO: 776979

SEQ ID NO: 776985 - protein, 807 aa, Homo sapiens; identical to SEQ ID NO: 776979

SEQ ID NO: 776986 - protein, 177 aa, Homo sapiens
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQRIWGHYQPETTLKFLLVCFVHLFLDHSISFNLGCRSAQGSVLRKIFCFSFLPKGKLRNTKFFAFPFCMANLFL

SEQ ID NO: 776987 - protein, 108 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKVYSS

SEQ ID NO: 776988 - protein, 170 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCLLRNNQP

SEQ ID NO: 776989 - protein, 377 aa, Homo sapiens
ELQCRLQVVRWLQLWQPRIPSSRLAPISADPGGDAVAKWGCGPSGGTRRRSTTQPHPWAAEGPARGTPSVGSLWKRRARGRQLNRPWGRARLGSREPRPPAAPPQQPPPALGARELLGRFLCLGPVGQGRLRCACSLVLTLLLGVSAERREALRSLCGGPWTDCFARCCSSEAAIPEGELKYGCRLQFAADDYGRRKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKISPHTCCYSWRKRYSHSSSAAQY

SEQ ID NO: 776990 - protein, 103 aa, Homo sapiens
TRFTRFSCLVLPSTWDYRHESPHLANFCIFSTRWGFAYTGQAGLKLLTSSNPSTLASQSAGITGMSHWYPALSPFFHFPSFPTIIQMSAPEQGPCLFCSLLYL

SEQ ID NO: 776991 - protein, 69 aa, Homo sapiens
AVWDALNLFYFIGDSDGIPLLKATIPKNQYRSFMSQGSPELLITISMNYLFNKLTEDSAWQMIINSLTM

SEQ ID NO: 776992 - protein, 136 aa, Homo sapiens
RWEMAHGKEQRPIYLLPTPAKPCPYRVPFAQNILQTPFRNQDGGWGNWFTVPSTFTACQIISGRHGFGFCLGPYRSRTRTILAGLQLPQAETMKASRSRLLHHQDLPDTMSYVPPHNSFPSPLTQISTVASLHAIL

SEQ ID NO: 776993 - protein, 124 aa, Homo sapiens
MTLGGRWLPLAGVCPSAECMIIPTLPLMGGLNRRYRRVCGTDKAHSRSTIDIGCVMIIMVSIVFKPQWLDFHKLKFTSQSTRTKFQNGFFSPRARHPQKLTKSGYGKTVQIYFQKTHPKLRVYT

SEQ ID NO: 776994 - protein, 104 aa, Homo sapiens
MAANSSGQGFQNKNRVAILAELDKEKRKLLMQNQSSTNHPGASIALSRPSLNKDFRDHAEQQHIAAQQKAALQHAHAHSSGYFITQDSAFGNLILPVLPRLDPE

SEQ ID NO: 776995 - protein, 104 aa, Homo sapiens; identical to SEQ ID NO: 776994

SEQ ID NO: 776996 - protein, 104 aa, Homo sapiens; identical to SEQ ID NO: 776994

SEQ ID NO: 776997 - protein, 104 aa, Homo sapiens; identical to SEQ ID NO: 776994

SEQ ID NO: 776998 - protein, 114 aa, Homo sapiens
VKKRHQPHVLPSKSPTNPGFQNKNRVAILAELDKEKRKLLMQNQSSTNHPGASIALSRPSLNKDFRDHAEQQHIAAQQKAALQHAHAHSSGYFITQDSAFGNLILPVLPRLDPE

SEQ ID NO: 776999 - protein, 81 aa, Homo sapiens
CGKSFNRSSTFTKHKVIHTGVKPYKCEECGKAFFWSSTLTKHKRIHTGEQPYKWEKFGKAFNRSSHLTTDKITHWREILQV

SEQ ID NO: 777000 - protein, 31 aa, Homo sapiens
MAWQIRLFEKEGMWQAQEESHPKGIEKGSGV

SEQ ID NO: 777001 - protein, 154 aa, Homo sapiens
CVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKVSTDNFFKRGYNF

SEQ ID NO: 777002 - protein, 154 aa, Homo sapiens; identical to SEQ ID NO: 777001

SEQ ID NO: 777003 - protein, 113 aa, Homo sapiens
MFLENELCLRTGLNKITEASLWHLIISQTTKEGSPSAMSIPGNRPLPREMPPVSQGYILGSDCILQSRKIVPAQGLMPVIPALWEAKVGRLLEPRSSRPARATWQNPVTTENT

SEQ ID NO: 777004 - protein, 482 aa, Homo sapiens
KVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 777005 - protein, 98 aa, Homo sapiens
KVEEEAMAPGLPTACSQEPVTFADVAVVFTPEEWVFLDSTQRSLYRDVMLENYRNLASVADQLCKPNALSYLEERGEQWTTDRGVLSDTCAGEPRQIR

SEQ ID NO: 777006 - protein, 232 aa, Homo sapiens
LSPHWPLPSLHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 777007 - protein, 219 aa, Homo sapiens
MSCAARVGIVAWHVGTVSAGYAGKTPIDIFYNLVSSCPGNSVRALQDSGVVSVTSDVAYLHEMSASEDPMWETTVMLDPVAVTLASMGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSGNNS

SEQ ID NO: 777008 - protein, 482 aa, Homo sapiens; identical to SEQ ID NO: 777004

SEQ ID NO: 777009 - protein, 199 aa, Homo sapiens
RHGGSVSGWLAGRTPTETSNPGSSVMESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSGNNS

SEQ ID NO: 777010 - protein, 173 aa, Homo sapiens
RHGGSVSGWLAGRTPTETSNPGSSVMESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTLPLLSLL

SEQ ID NO: 777011 - protein, 89 aa, Homo sapiens
SAICFLPGPWLMHQELEEMEWCSEPLPFRVQSNQMGIMLNVGETKESLALGLFSENLPPAKQNGGGDDDGDDGSGHFFAYPLWPCCEEL

SEQ ID NO: 777012 - protein, 114 aa, Homo sapiens
GRLLLLNSRPLDRPRHGLCLRARPASYSALILHDDEVTVTEDKINALIKAAGVNVEPFVAWLCFAKAPGPNRQHVGSLILQCRGPVDPCFTKTSLGAATQQGRSCPLHWLLAPA

SEQ ID NO: 777013 - protein, 114 aa, Homo sapiens
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 777014 - protein, 114 aa, Homo sapiens; identical to SEQ ID NO: 777013

SEQ ID NO: 777015 - protein, 114 aa, Homo sapiens; identical to SEQ ID NO: 777013

SEQ ID NO: 777016 - protein, 114 aa, Homo sapiens; identical to SEQ ID NO: 777013

SEQ ID NO: 777017 - protein, 104 aa, Homo sapiens
MLGLSFGQYDYMVTDRAAGALSVTRKVTVTEDKINALIKAAGVNVEPFVAWLCCAKAPGPNRQHVGSLILQCRGPVDPCFTKTSLGAATQQGRSCPLHWLLAPA

SEQ ID NO: 777018 - protein, 114 aa, Homo sapiens; identical to SEQ ID NO: 777013

SEQ ID NO: 777019 - protein, 114 aa, Homo sapiens; identical to SEQ ID NO: 777013

SEQ ID NO: 777020 - protein, 107 aa, Homo sapiens
PALTTGVHDDEVTVTEDKINALIKAAGVNVEPFVAWLCFAKAPGPNRQHVGSLILQCRGPVDPCFTKTSLGAATQQGRSCPLHWLLAPAEEIESGSNKKSRVGPLDH

SEQ ID NO: 777021 - protein, 114 aa, Homo sapiens; identical to SEQ ID NO: 777013

SEQ ID NO: 777022 - protein, 100 aa, Homo sapiens
WEMLSPQPVQRNMIPDPEMEEETEFLELGTRISRPNGLLSEDVGMDIPFEEGVLSPRAADMRPEPPNSLDLNDTHPRRPRWSSAAAKVLGPSEEAKAALG

SEQ ID NO: 777023 - protein, 114 aa, Homo sapiens; identical to SEQ ID NO: 777013

SEQ ID NO: 777024 - protein, 100 aa, Homo sapiens; identical to SEQ ID NO: 777022

SEQ ID NO: 777025 - protein, 100 aa, Homo sapiens; identical to SEQ ID NO: 777022

SEQ ID NO: 777026 - protein, 100 aa, Homo sapiens; identical to SEQ ID NO: 777022

SEQ ID NO: 777027 - protein, 100 aa, Homo sapiens; identical to SEQ ID NO: 777022

SEQ ID NO: 777028 - protein, 100 aa, Homo sapiens; identical to SEQ ID NO: 777022

SEQ ID NO: 777029 - protein, 100 aa, Homo sapiens; identical to SEQ ID NO: 777022

SEQ ID NO: 777030 - protein, 100 aa, Homo sapiens; identical to SEQ ID NO: 777022

SEQ ID NO: 777031 - protein, 100 aa, Homo sapiens; identical to SEQ ID NO: 777022

SEQ ID NO: 777032 - protein, 100 aa, Homo sapiens; identical to SEQ ID NO: 777022

SEQ ID NO: 777033 - protein, 100 aa, Homo sapiens; identical to SEQ ID NO: 777022

SEQ ID NO: 777034 - protein, 100 aa, Homo sapiens; identical to SEQ ID NO: 777022

SEQ ID NO: 777035 - protein, 100 aa, Homo sapiens; identical to SEQ ID NO: 777022

SEQ ID NO: 777036 - protein, 100 aa, Homo sapiens; identical to SEQ ID NO: 777022

SEQ ID NO: 777037 - protein, 114 aa, Homo sapiens; identical to SEQ ID NO: 777013

SEQ ID NO: 777038 - protein, 100 aa, Homo sapiens; identical to SEQ ID NO: 777022

SEQ ID NO: 777039 - protein, 100 aa, Homo sapiens; identical to SEQ ID NO: 777022

SEQ ID NO: 777040 - protein, 100 aa, Homo sapiens; identical to SEQ ID NO: 777022

SEQ ID NO: 777041 - protein, 100 aa, Homo sapiens; identical to SEQ ID NO: 777022

SEQ ID NO: 777042 - protein, 100 aa, Homo sapiens; identical to SEQ ID NO: 777022

SEQ ID NO: 777043 - protein, 100 aa, Homo sapiens; identical to SEQ ID NO: 777022

SEQ ID NO: 777044 - protein, 112 aa, Homo sapiens
ASKLGVNRRRRPRHGLCLRARPASYSALILHDDEVTVTEDKINALIKAAGVNVEPFVAWLCFAKAPGPNRQHVGSLILQCRGPVDPCFTKTSLGAATQQGRSCPLHWLLAPA

SEQ ID NO: 777045 - protein, 44 aa, Homo sapiens
MESDDAWRIISSLLSLCDATRRARNAQQQSSRLTETRETRFSFP

SEQ ID NO: 777046 - protein, 100 aa, Homo sapiens; identical to SEQ ID NO: 777022

SEQ ID NO: 777047 - protein, 89 aa, Homo sapiens
IRGRVDTVREDDRREEDKINALIKAAGVNVEPFVAWLCFAKAPGPNRQHVGSLILQCRGPVDPCFTKTSLGAATQQGRSCPLHWLLAPA

SEQ ID NO: 777048 - protein, 97 aa, Homo sapiens
LGNITSEFTSNSFCTTMEVDRSPEDKINALIKAAGVNVEPFVAWLCFAKAPGPNRQHVGSLILQCRGPVDPCFTKTSLGAATQQGRSCPLHWLLAPA

SEQ ID NO: 777049 - protein, 100 aa, Homo sapiens; identical to SEQ ID NO: 777022

SEQ ID NO: 777050 - protein, 100 aa, Homo sapiens; identical to SEQ ID NO: 777022

SEQ ID NO: 777051 - protein, 100 aa, Homo sapiens; identical to SEQ ID NO: 777022

SEQ ID NO: 777052 - protein, 63 aa, Homo sapiens
KRWSPVRPPLEVVVPRAGIRHDLHPATSTAFPAAPALTLARAMASVSELALHPTRPSFCTTMR

SEQ ID NO: 777053 - protein, 100 aa, Homo sapiens; identical to SEQ ID NO: 777022

SEQ ID NO: 777054 - protein, 348 aa, Homo sapiens
MVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 777055 - protein, 114 aa, Homo sapiens; identical to SEQ ID NO: 777013

SEQ ID NO: 777056 - protein, 114 aa, Homo sapiens; identical to SEQ ID NO: 777013

SEQ ID NO: 777057 - protein, 114 aa, Homo sapiens; identical to SEQ ID NO: 777013

SEQ ID NO: 777058 - protein, 114 aa, Homo sapiens; identical to SEQ ID NO: 777013

SEQ ID NO: 777059 - protein, 114 aa, Homo sapiens; identical to SEQ ID NO: 777013

SEQ ID NO: 777060 - protein, 114 aa, Homo sapiens; identical to SEQ ID NO: 777013

SEQ ID NO: 777061 - protein, 114 aa, Homo sapiens; identical to SEQ ID NO: 777013

SEQ ID NO: 777062 - protein, 147 aa, Homo sapiens
CYSFLQSELEESAIPCLSNLKSSQGPKGHKRLQGQVRASSLHHHSSSITIATPGVNNGARKGFPTKPPLLALRPRRMASNRQRSLRGPSHPSHMEEPFLQVGGGPSLPPTFLYPTGLQAVPYSGPGFLLGSRLPGPYIFCCLPLFIL

SEQ ID NO: 777063 - protein, 684 aa, Homo sapiens
RFCLEVLIVNNSFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 777064 - protein, 760 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 777065 - protein, 818 aa, Homo sapiens
PRLVLGGARARGELREARRGGGRVRGGPPLPLPGPGGCLEPPEFPHPGGRCGRGSGSLQIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 777066 - protein, 741 aa, Homo sapiens
MAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 777067 - protein, 466 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKVSTESGAS

SEQ ID NO: 777068 - protein, 466 aa, Homo sapiens; identical to SEQ ID NO: 777067

SEQ ID NO: 777069 - protein, 403 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKVSTESGAS

SEQ ID NO: 777070 - protein, 379 aa, Homo sapiens
QSSWYLDEQALVCDGVPQRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 777071 - protein, 70 aa, Homo sapiens
PRAAGFGTRANPNAASYHGNLAVLYHRWGHLDLAKKHYEISLQLDPTASGTKENYGLLRRKLELMQKKAV

SEQ ID NO: 777072 - protein, 466 aa, Homo sapiens; identical to SEQ ID NO: 777067

SEQ ID NO: 777073 - protein, 500 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRGHWEMIRWFQKCFNAQLRISLTEIYGGDVATKKWILTLGLGFLVIPFLPASNLFFRVGFVVAERVLYLPSVGYCVLLTFGFGALSKHTKKKVSTESGAS

SEQ ID NO: 777074 - protein, 631 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLVSAGCPVPVEGKMGYFSYL

SEQ ID NO: 777075 - protein, 626 aa, Homo sapiens
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLVSAGCPVPVEGKMG

SEQ ID NO: 777076 - protein, 134 aa, Homo sapiens
EIKILGMEEPSNVTVKHNGVPSQTSPTVTYDSNLKVAIITDINLFLGEAYTVEWSIKIRDEEKIDCYPDENGDSAENCTARGCIWEASNSSGVPFCYFVNDLYSVSDVQYNSHGATADISLKSSVHANAFPSTP

SEQ ID NO: 777077 - protein, 369 aa, Homo sapiens
AEGFALRKDGRGGFWSQLGAQYAFSGAWAEETGTSVASVSTDWLKRAPRELTGSAIRGKAFVVPEKSSQSGAVAAAFCGFPLFPQTRTFSASLRRIVTKMWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 777078 - protein, 369 aa, Homo sapiens; identical to SEQ ID NO: 777077

SEQ ID NO: 777079 - protein, 457 aa, Homo sapiens
AEGFALRKDGRGGFWSQLGAQYAFSGAWAEETGTSVASVSTDWLKRAPRELTGSAIRGKAFVVPEKSSQSGAVAAAFCGFPLFPQTRTFSASLRRIVTKMWNSNDGGAGWRRKRIAGGFSKRASLGSERRVVAGEEGRERSWGVWGSPAGRRRGRLGRLGQCLKGRSLREPAGFSEAWDVAQALILLFKTGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 777080 - protein, 278 aa, Homo sapiens
MGRGDRNKRSIRGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 777081 - protein, 324 aa, Homo sapiens
AEGFALRKDGRGGFWSQLGAQYAFSGAWAEETGTSVASVSTDWLKRAPRELTGSAIRGKAFVVPEKSSQSGAVAAAFCGFPLFPQTRTFSASLRRIVTKMWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQGNSFMPANGLTVAI

SEQ ID NO: 777082 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 777083 - protein, 354 aa, Homo sapiens
AEGFALRKDGRGGFWSQLGAQYAFSGAWAEETGTSVASVSTDWLKRAPRELTGSAIRGKAFVVPEKSSQSGAVAAAFCGFPLFPQTRTFSASLRRIVTKMWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQFQDLKNQLKHMSVSSIKQAVDFLSNEGHIYSTVDDDHFKSTDAE

SEQ ID NO: 777084 - protein, 143 aa, Homo sapiens
KDTKAPGYTNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 777085 - protein, 181 aa, Homo sapiens
LWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGF

SEQ ID NO: 777086 - protein, 143 aa, Homo sapiens
PGSSYPPTSTSRVVETTGVHYHARLPFCIFSRDEVSPCCPGWFKRSSSNQPASASQSVGITGMSRCAQPSSAVEILLITCLLQNSCGFSLLNGLSSCLSWLSSLSEVLNERTCKAFRECQGGNGRVFPGLENLYREMDLGKEF

SEQ ID NO: 777087 - protein, 158 aa, Homo sapiens
MVSPPCLRTYSLVRRWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTRRTRAHPEPITPHRYTG

SEQ ID NO: 777088 - protein, 370 aa, Homo sapiens
MGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 777089 - protein, 514 aa, Homo sapiens
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 777090 - protein, 410 aa, Homo sapiens
MATCHSHRTNSWQISVPSAFVWSVAPIKNVSRRSWVVDDNVLQHNSLSLHIFSHIQHDSSNGWEHGVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 777091 - protein, 370 aa, Homo sapiens; identical to SEQ ID NO: 777088

SEQ ID NO: 777092 - protein, 110 aa, Homo sapiens
LPTALLIKAKLISAVLQGTLFPSPAAQPPPPLRSASHETSLPVSCHPSGHRRTSDISSGEDSGMLPGYCQANATSFDAWVTVEFVGPLAKRTNSPTSIAEIVSPAASSPT

SEQ ID NO: 777093 - protein, 91 aa, Homo sapiens
LPTALLIKAKLISAVLQGTLFPSPAAQPPPPLRSASHETSLPVSCHPSGHRRTSDIRNCQSCCLQSYMRISISGKEENTDWSYEKQWPRLP

SEQ ID NO: 777094 - protein, 119 aa, Homo sapiens
QPSTQNKFNYPHKKYSGIMSIPYFQHHPVKKLAGLRLSQNNKLALLYVSFCQLDLWIQCNPNQNPAKYFVDPDKLVLKFTWKGKRPRIAGTILKEKKVRRLILPNFKTHYKATVIKIGW

SEQ ID NO: 777095 - protein, 195 aa, Homo sapiens
MEYFGTIGIGTPAQDFTVLFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITSVERGTSR

SEQ ID NO: 777096 - protein, 268 aa, Homo sapiens
MKWLLLLGLVALSECIMYKVPLIRKKSLRRTLSERGLLKDFLKKHNLNPARKYFPQWKAPTLVDEQPLENYLDMEYFGTIGIGTPAQDFTVLFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITSVERGTSR

SEQ ID NO: 777097 - protein, 36 aa, Homo sapiens
MVKGCWGLSESPLMSASSGSFLSCKFSLLSRWIRRP

SEQ ID NO: 777098 - protein, 395 aa, Homo sapiens
MGEGGAAAALVAAAAAAAAAAAAVVAGQRRRRLGRRARCHGPGRAAGRKMSKPRAVEAAAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGAFVVEYHGDLIEITDAKKREALYAQDPSTGCYMYYFQYLSKTYCVDATRETNRLGRLINHSKRGNCQTKLHDIDGVPHLILIASRDIAAGEEPLYDYGDRSKASIEAHPWLKH

SEQ ID NO: 777099 - protein, 274 aa, Homo sapiens
MARGRKMSKPRAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGAFVVEYHGDLIEITDAKKREALYAQDPSTGCYMYYFQYLSKTYW

SEQ ID NO: 777100 - protein, 136 aa, Homo sapiens
MARGRKMSKPRAVEAAAAAAAVAATAPGPEMVERRGPGRPRTDGENVFTGQSKIYSYMSPNKCSGMRFPLQEENSVTHHEVKCQGKPLAGIYRKREGKLLKWPRSDPSWSGCRSLCLLQECTYVFIQPFQSQIREV

SEQ ID NO: 777101 - protein, 283 aa, Homo sapiens
MARGRKMSKPRAVEAAAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGAFVVEYHGDLIEITDAKKREALYAQDPSTGCYMYYFQYLSKTYW

SEQ ID NO: 777102 - protein, 208 aa, Homo sapiens
SGRSRSRTRGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGAFVVEYHGDLIEITDAKKREALYAQDPSTGCYMYYFQYLSKTYW

SEQ ID NO: 777103 - protein, 203 aa, Homo sapiens
TGFHRVGWTGLKLLTSEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGAFVVEYHGDLIEITDAKKREALYAQDPSTGCYMYYFQYLSKTYW

SEQ ID NO: 777104 - protein, 567 aa, Homo sapiens
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777105 - protein, 47 aa, Homo sapiens
MLTQERPRTHTAPSRVQDVPREFLPRTLTGYVPEDIWRKAGEWGCRG

SEQ ID NO: 777106 - protein, 592 aa, Homo sapiens
MPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777107 - protein, 690 aa, Homo sapiens
RAEDTQLVAGRASAFQGQRPNSRTPQLAQPLLFPSRLQEVGKGSPGRGLSWAPGWPLRVALLMPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777108 - protein, 690 aa, Homo sapiens; identical to SEQ ID NO: 777107

SEQ ID NO: 777109 - protein, 153 aa, Homo sapiens
RPPRAPQPRRAPEPGAAPEDSAQPPLSRGGGDQAGRSSDSRTESRVCAVRRPPDPPDPPTVSAVSAPRAAAALPRLRPRLPFPDLRRSRAERTGRFQSWCPRQGGANPPSAHPSGLSAAPREQSLTCGGCGETSRGTTRPGAGSLAGSPGAAR

SEQ ID NO: 777110 - protein, 715 aa, Homo sapiens
RAEDTQLVAGRASAFQGQRPNSRTPQLAQPLLFPSRLQEVGKGSPGRGLSWAPGWPLRVALLMPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777111 - protein, 607 aa, Homo sapiens
RAEDTQLVAGRASAFQGQRPNSRTPQLAQPLLFPSRLQEVGKGSPGRGLSWAPGWPLRVALLMPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQLVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777112 - protein, 590 aa, Homo sapiens
MENLVSPQLCVSAPVDRKAKASAMPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 777113 - protein, 690 aa, Homo sapiens; identical to SEQ ID NO: 777107

SEQ ID NO: 777114 - protein, 108 aa, Homo sapiens
MEGTQSPSPGGRHEKGPQIPGLLSARLLKGAITIPTQFQQNKNEGSGALGICLGCTPTLTICLPDIPPLLLHLLKEERNSPSSLPSTGNPSCTSPHSTCPGRLHAMPP

SEQ ID NO: 777115 - protein, 321 aa, Homo sapiens
MATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 777116 - protein, 321 aa, Homo sapiens; identical to SEQ ID NO: 777115

SEQ ID NO: 777117 - protein, 321 aa, Homo sapiens; identical to SEQ ID NO: 777115

SEQ ID NO: 777118 - protein, 335 aa, Homo sapiens
KIKCFLSKKRAGAAMATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 777119 - protein, 321 aa, Homo sapiens; identical to SEQ ID NO: 777115

SEQ ID NO: 777120 - protein, 154 aa, Homo sapiens [sequence omitted]

SEQ ID NO: 777121 - protein, 295 aa, Homo sapiens
MATGGQQKENTLLHLFAGGCGGTVGAIFTCPLEVIKTRLQSSRLALRTVYYPQVHLGTISGAGMVRPTSVTPGLFQVLKAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 777122 - protein, 160 aa, Homo sapiens
ELATVHSCPLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 777123 - protein, 250 aa, Homo sapiens
KGGTRALLEAIRVHPDVRAVGVEPHFFDRNYEKGLEWYRNVMPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 777124 - protein, 209 aa, Homo sapiens
MPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 777125 - protein, 554 aa, Homo sapiens
RYEAGVNRPRMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 777126 - protein, 556 aa, Homo sapiens
IQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 777127 - protein, 78 aa, Homo sapiens
LCALQGEPGVCKMCLFLFVVYTFPSLALHGLFIFKSANLQPQTSWGPEAVNPSSLPCDPQSASCSHFHSSSAYIFNIL

SEQ ID NO: 777128 - protein, 114 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLVCI

SEQ ID NO: 777129 - protein, 102 aa, Homo sapiens
GRVPGRACQRGWRQWWLSRLGCQSVRGGGRWLTGTRSARKKGSRWCCYSGGSRAASVAVAESLTSRGPAGGAPAAALVEGLEQMWKNVYFRERGCGGMVVRV

SEQ ID NO: 777130 - protein, 240 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRQYKGISSRIPVSSGFMVQC

SEQ ID NO: 777131 - protein, 101 aa, Homo sapiens
MEGCLRIEEALTLGGACLFAGLAFLWAAFAQHFSAADSPGTEFTPATTTSRLLHVLYVCSCSLVAEKDDFSSPHSHSLLLVSLPEPHFELSEGLRLAFRGS

SEQ ID NO: 777132 - protein, 66 aa, Homo sapiens
MAPLVAEGPLAPAAVAAGSKTEERHLLHHGHRSPPFHSTRDPAHCHCHHSQDKDLIQGQAFSAPCA

SEQ ID NO: 777133 - protein, 54 aa, Homo sapiens
RDVKKGSEPCSPLGDSPPSREQHVERLSVGSCLHGIKEARVAENKKSGWKHRET

SEQ ID NO: 777134 - protein, 177 aa, Homo sapiens
SAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 777135 - protein, 474 aa, Homo sapiens
MSIQAPPRLLELAGQSLLRDQALSISAMEELPRVLYLPLFMEAFSRRHFQTLTVMVQAWPFTCLPLGSLMKTLHLETLKALLEGLHMLLTQKDRPRRWKLQVLDLRDVDENFWARWPGAWALSCFPETTSKRQTAEDCPRMGEHQPLKVFIDICLKEIPQDECLRYLFQWVYQRRGLVHLCCSKLVNYLTPIKYLRKSLKIIYLNSIQELEIRNMSWPRLIRKLRCYLKEMKNLRKLVFSRCHHYTSDNELQGRLVAKFSSVFLRLEHLQLLKIKLITFFSGHLEQLIRCLQNPLENLELTYGYLLEEDMKCLSQYPSLGYLKHLNLSYVLLFRISLEPLGALLEKIAASLKTLILEGCQIHYSQLSAILPALSRCSQLTTFYFGRNCMSIDALKDLLRHTSGLSKLSLETYPAPEESLNSLVRVNWEIFTPLRAELMCTLREVRQPKRIFIGPTPCPSCGSSPSEELELHLCC

SEQ ID NO: 777136 - protein, 518 aa, Homo sapiens
THSSKKIWIIRRERSAASTPYSVVFLLGIKAKLFLIRDSFPQARLILFCQSTSPSLPLDKDPMPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKVSSSEVAVTGMASSAIAAQSGQAWVWAHRHIGEERDVGCWWWLLASEVDAHLLPVPGLPQNAIRHNLSLHKCFVRVESEKGAVWTVDELEFRKKRSQRPSRCSNPTPGP

SEQ ID NO: 777137 - protein, 493 aa, Homo sapiens
THSSKKIWIIRRERSAASTPYSVVFLLGIKAKLFLIRDSFPQARLILFCQSTSPSLPLDKDPMPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 777138 - protein, 193 aa, Homo sapiens
SLGVHRVYTQQDLLYQNDCVFLHCNLNEQNYHLIHDFTIKQMRQGAFLVNAARGGLVDEKAWAHILKEGRIRGAALDVNESEPFSFARGLLKDAWNLICTPLTACYSQQVSLEMSEAVATEIRQAIISRIPGSLRNCVNKEFFVTSALWSVINQQEIHPELSGATYRYLPGMVGVAPGGLLQPGKTSSLETSQ

SEQ ID NO: 777139 - protein, 62 aa, Homo sapiens
MGHLSHDYPGWHTSLSPNTQYFQVAWREQEDEKDHWVVPASHTQPFQPLRLRANSVICTSLS

SEQ ID NO: 777140 - protein, 89 aa, Homo sapiens
DNAAGMVRDRTKAQARRLHETCSCWDLLRDNAAGDGQKQTQGPSCWDPLRDNAAGMVRDRPKAQARCLHKTCSVTMPLGTVRDRPKAHL

SEQ ID NO: 777141 - protein, 186 aa, Homo sapiens
VAPLQSLSAVTSSDQRRRSKEARTPGTRDTDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYECKKKKKKKKKKKKKKKKKNKKKERGGRAPKRFPPGGRQLKGQPRIFGKKRGPHL

SEQ ID NO: 777142 - protein, 69 aa, Homo sapiens
TSRCAPLWGLLTPEGPQVEEGPQVEVGPVLAAGEVNRTPGHPRVWEMDSVVFEDVAVNFTQIHFLCGSA

SEQ ID NO: 777143 - protein, 170 aa, Homo sapiens
TSRCAPLWGLLTPEGPQVEEGPQVEVGPVLAAGEVNRTPGHPRVWEMDSVVFEDVAVNFTQEEWALLGPSQKKLYRDVMQETFVNLASIGENWEEKNIEDHKNQGRKLRSHMVERLCERKEEMGFCHVAQTGLKLLSSSDPPASASQNTGIIGVSHHAQPKTLNLEEHCK

SEQ ID NO: 777144 - protein, 102 aa, Homo sapiens
NIFVDVVKNISCKSISSLVMCQYHLFNKVLLKCSSKVQLCSRGSEKCAPNMVVGNRAFPLRKELLGLEMKGLGNLPKPSAYSGAERTEFFLCSLVISGWSME

SEQ ID NO: 777145 - protein, 31 aa, Homo sapiens
MLPSTGRSPPPWPAQLSVSHCSPLELTPYTK

SEQ ID NO: 777146 - protein, 141 aa, Homo sapiens
QEPLRRVVGEREEHERPPSEPDFCGDSRRRDSGLDSGLSSAEDSCPHCDQWEHTIEEAPLAPVHPRSCHPVQCRFCLGLFPLHSRCGHLILCSLLSSPSSQFHCALGVLAFSRNPFSVSVPSADTPFRLCLQEPRHLVLSL

SEQ ID NO: 777147 - protein, 42 aa, Homo sapiens
KACVELALLLEPEGYLVEKRSRYRECKQDSRRSWDRTERSEN

SEQ ID NO: 777148 - protein, 118 aa, Homo sapiens
SSLVSGSRTHDVLETLKFTPGSSCPRDKELRTGMSWTVNWSDICPSLHQQTAPRASQVICHRIPCFPRVSERGPQKLSPRWKCRARLLKFCSRIMRTPRKFSAPLHSPKPLHKPPPFV

SEQ ID NO: 777149 - protein, 122 aa, Homo sapiens
LGLQACATITRLIFVFLVEMGFHHVGWAGLKLLTSNDPPVSASKSVGNTGVSHHARPQCHMFNIFCHVVQAGLKFLDSCHPPALASQSAGITGVSYHTRPALEILKFSIVRARFNSLKAPKT

SEQ ID NO: 777150 - protein, 36 aa, Homo sapiens
FSLTRSGTTIRQRMLQTLASIFNYLAFFPPDCQPCN

SEQ ID NO: 777151 - protein, 107 aa, Homo sapiens
YIFFLRLSLALSPSLECSGAISAHCNLADRARLHLKGEKQKTNKQKNTNETKPNQNARDPWQVPASLRLSCSLVKWGHCNCLAGPLQIKECRAIPRSQGLAAAQEEK

SEQ ID NO: 777152 - protein, 72 aa, Homo sapiens
MEYFDTSHVRIRLFSFLSPGVQMALTLGACHSLAQSLSSPSFQAQSLSSPSFQAQSLSSPPFPGSDPLLFLL

SEQ ID NO: 777153 - protein, 226 aa, Homo sapiens
MSDLKCVQDAKGGSFYRDHCPVLGEQNGNRNPGGLQIGDLVNIDLDLEIVQSLQHGHGGWTDGMFETLTTTGTVCGIDEDHDIVVQYPSGNRWTFNPAVLTKANIVRSGDAAQGAEGGTSQFQVGDLVQVCYDLERIKLLQRGHGEWAEAMLPTLGKVGRVQQIYSDSDLKVEVCGTSWTYNPAAVSKVASAGSAISNASGERLSQLLKKLFETQESGDLNEELVK

SEQ ID NO: 777154 - protein, 184 aa, Homo sapiens
MCDTCRQQPIIGIRWKCAECTNYDLCTVCYHGDKHHLRHRFYRITTPGSERVLLESRRKSKKITARGIFAGARVVRGVDWQWEDQDGGNGRRGKVTEIQDWSASSPHSAAYVLWDNGAKNLYRVGFEGMSDLKCVQDAKGGSFYRDHCPVLGEQNGTDPGGCDVVACNFDSTRIVALALVGGGG

SEQ ID NO: 777155 - protein, 100 aa, Homo sapiens
MSWVGQEHQDHFRKFSRESQNMCLLHLCPLATMSQAKKSLGEENPMQLWSVCWAQSWVPHPLPALIPKAAVGHRFPHLTGHLNQRFSTSLVLTCEAGCFF

SEQ ID NO: 777156 - protein, 91 aa, Homo sapiens
STVPRVQTVPRVQTVPRVQTVPRVQTVPRVQTVPKLLAEPDTPHAVCPCSRIILRHLPTAPSIHHTPTLPQSYHFLFEIVFKCGDPPTAVN

SEQ ID NO: 777157 - protein, 116 aa, Homo sapiens
VLALCPQCLSTLSGRPGDYLAQSITCATHLSTPPGGLRLSPPNLPLITAAGTHLHVPPVGLGTGLPSLSQSPSTSAWTAWNPEVSPAIANDITEAISASRGQRTHLATCLTHCCHY

SEQ ID NO: 777158 - protein, 227 aa, Homo sapiens
SGGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWMQFLQKRLLPRFIPN

SEQ ID NO: 777159 - protein, 47 aa, Homo sapiens
MLTNANVVNLFTKNPRSSKVSCYSLMRIFHCIGISIASTSYIGPRST

SEQ ID NO: 777160 - protein, 65 aa, Homo sapiens
MAQPDGGDRWQIEDYNSVPPSGRRQRRRCLLPVDGSGQAGQGSLESAGPQCFGERGRSQHDVPMC

SEQ ID NO: 777161 - protein, 101 aa, Homo sapiens
VSLASRPSGNRAGATPQGVGLRTAKINRGYRRGVTHRRGAGEGLVGAPGRLRPWLCLWTRRAPRSLGPPRLQLRRLRPETPGRSFSSSRRLLSSEELSAGG

SEQ ID NO: 777162 - protein, 110 aa, Homo sapiens
MAPFQARVSKTNFLKLASSGQWVSGREGGCLYCRLKFNLYLGTVCFIWFWVKGGRCQARLSPFQLLFLKKTKKREKQNNQTPVAQGHAALWAAYMSFLYPTTKRHPWNQR

SEQ ID NO: 777163 - protein, 466 aa, Homo sapiens
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 777164 - protein, 421 aa, Homo sapiens
MHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 777165 - protein, 421 aa, Homo sapiens; identical to SEQ ID NO: 777164

SEQ ID NO: 777166 - protein, 278 aa, Homo sapiens
MHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 777167 - protein, 421 aa, Homo sapiens; identical to SEQ ID NO: 777164

SEQ ID NO: 777168 - protein, 90 aa, Homo sapiens
MPRLVCSSEILAHCNLCLPGLRDSCASASQIGGTTGVCQHIWLIFVYLVEMRFHHVGQAGLDCLTSGDPPASASQSAGITGVSHCTWPRP

SEQ ID NO: 777169 - protein, 146 aa, Homo sapiens
NGPSVRKLILAPTERLPQMKSVSTRRDPQACPDPPTPAVGPTCVPFLEELLPAASVLCFLLALPCTPRTAPGLTGDTSLWASAANQAAGPSLPSTGGGTRSVGRGPSLLSTGGGTCSVGHGPSLPSTGGGTGCVGPGSSMSEGTAL

SEQ ID NO: 777170 - protein, 95 aa, Homo sapiens
RTLQEDLKRAGEGSAPSPRSYQKPQLGCHAPRATQQFLTTLKAATSAMGGWSRGSLRESASQTLGGAGEAAGKSMGQEVGVPAIISEPSPAPNKH

SEQ ID NO: 777171 - protein, 118 aa, Homo sapiens
SLASAQDISPLLPGHGGGSGGRGLISQAVRLRSACDPDSNSAWGRLWGCPAAGARRNPVLPQQHGTVGPEPCTERFAPDEASCQPRRNPAAHSLPEGEAVNPRCCAAGQSPARARLPP

SEQ ID NO: 777172 - protein, 101 aa, Homo sapiens
YTALYAELRSKQDGKASNSRNDKTEPSLGMMRQGAGVSLRAQCKQRHRRAGWRDVQPERTLPWSRQRVKAGTDEDVSPLKTNKQKKTVSLCHPSWSAMVQS

SEQ ID NO: 777173 - protein, 100 aa, Homo sapiens
RRAGPEGPMSRAAWAVYRGETPGNCELGDSGILQTRLEPAREESGVDDSASELAERAWLLHGLSGRYLTQMRQVHTRGFIWSTFSQEVRMIRELTNFPVD

SEQ ID NO: 777174 - protein, 101 aa, Homo sapiens
DHLSLGIEKEREREKRGREREREREVFFMSLLILLLGRQMHLGDFLQLILQDQQVPVSEDHTPLKKALPLSSLKMVLQQSRVSVYLSSASLCLDCICIPST

SEQ ID NO: 777175 - protein, 104 aa, Homo sapiens
VRGARRVRREGTAVRKGDFLRWLQVGSRRVPRGVWRTCLAVASEGWGIHPPTSTPHRLMVVPSRCWLSPPCFHTIQQGWSPSLALEKVLKAAQGRPHGYGGGSE

SEQ ID NO: 777176 - protein, 160 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 777177 - protein, 160 aa, Homo sapiens; identical to SEQ ID NO: 777176

SEQ ID NO: 777178 - protein, 160 aa, Homo sapiens; identical to SEQ ID NO: 777176

SEQ ID NO: 777179 - protein, 160 aa, Homo sapiens; identical to SEQ ID NO: 777176

SEQ ID NO: 777180 - protein, 111 aa, Homo sapiens
DAWVADAWVPDRRSRSFRAVHSGARGRARRCRRRLREARRGRDRREKAESPPERSRLPSSSRRQRGPPTSSPVPLPRSQYSIQKREEGSDFVFGKAACFCKVVRSKGLCLH

SEQ ID NO: 777181 - protein, 160 aa, Homo sapiens; identical to SEQ ID NO: 777176

SEQ ID NO: 777182 - protein, 160 aa, Homo sapiens; identical to SEQ ID NO: 777176

SEQ ID NO: 777183 - protein, 160 aa, Homo sapiens; identical to SEQ ID NO: 777176

SEQ ID NO: 777184 - protein, 160 aa, Homo sapiens; identical to SEQ ID NO: 777176

SEQ ID NO: 777185 - protein, 160 aa, Homo sapiens; identical to SEQ ID NO: 777176

SEQ ID NO: 777186 - protein, 113 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKTGKMIQMKTCLILIVSLR

SEQ ID NO: 777187 - protein, 130 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKMMNNMGGDEDVDLPEVDGADDDSQDSDDEKMPDLE

SEQ ID NO: 777188 - protein, 165 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKKNNFSARFHN

SEQ ID NO: 777189 - protein, 160 aa, Homo sapiens; identical to SEQ ID NO: 777176

SEQ ID NO: 777190 - protein, 160 aa, Homo sapiens; identical to SEQ ID NO: 777176

SEQ ID NO: 777191 - protein, 160 aa, Homo sapiens; identical to SEQ ID NO: 777176

SEQ ID NO: 777192 - protein, 110 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKGRFHFPFLKSLIFLF

SEQ ID NO: 777193 - protein, 107 aa, Homo sapiens
DAWVADAWVPDRRSRSFRAVHSGARGRARRCRRRLREARRGRDRREKAESPPERSRLPSSSRRQRGPPTSSPVPLPRSQCSLLLQSGTIEGTMSSLNFVLKTVRMLM

SEQ ID NO: 777194 - protein, 160 aa, Homo sapiens; identical to SEQ ID NO: 777176

SEQ ID NO: 777195 - protein, 160 aa, Homo sapiens; identical to SEQ ID NO: 777176

SEQ ID NO: 777196 - protein, 148 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDSR

SEQ ID NO: 777197 - protein, 139 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEDSQDSDDEKMPDLE

SEQ ID NO: 777198 - protein, 160 aa, Homo sapiens; identical to SEQ ID NO: 777176

SEQ ID NO: 777199 - protein, 123 aa, Homo sapiens
NKVSYHLNQVPEPCGIMNCHKMWLKVLVVCAVHSGARGRARRCRRRLREARRGRDRREKAESPPERSRLPSSSRRQRGPPTSSPVPLPRSQYSIQKREEGSDFVFGKAACFCKVVRSKGLCLH

SEQ ID NO: 777200 - protein, 236 aa, Homo sapiens
ESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALALKMDLSDIKNSYIRKKEIPFSSEQKWMAVKCSLKTE

SEQ ID NO: 777201 - protein, 568 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAAAWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 777202 - protein, 109 aa, Homo sapiens
YFPKDKECVPCLLRRMFFQHVYLPGGNQFQKSVISSKEAKWQRRSPQGKLISKASFLSSKPFSLVFLGASFQPIEISLDPSQPSIRFEEMAVSLGFFLSFKLILLNQRV

SEQ ID NO: 777203 - protein, 105 aa, Homo sapiens
WFTLGPQQSWADSGWGHCKDFPASLAVDAGCHLRHLPRASPWGLGSCLAWLGGSKTNIPRKMRQKPDHLFGPGFRSHPASLLLHLFLRNTEYQTPSLDGRGPHGL

SEQ ID NO: 777204 - protein, 253 aa, Homo sapiens
GRGISWGCYQGRDCEEGRTLLGQKEHILRRRGPCLPHQALGHQEDPHLQASLAFQGERGPCSSFIMNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 777205 - protein, 104 aa, Homo sapiens
MPAFPLPSTMIVNFLRPPQLCFLYSLWNYESIKPLFFINHPVSGSSLWQREKGLIQPRYSNSSGSFDRVVPLSQDNHSLAHHAEEPLGTVTFLIVWGLSQRVTP

SEQ ID NO: 777206 - protein, 100 aa, Homo sapiens
FPHNCDALSFDIKNAVCRSNIPLNTQLSEMVSHRKDLEKDTKQIRAIFLFEFKMGCKAVETTRNINNPFGPGTANECTVEWWFKKSGKGDESLEDEECSG

SEQ ID NO: 777207 - protein, 56 aa, Homo sapiens
CSPDTWRSPPHPQLEGWLPFGGLQINSHSAVGEAYVSGQAGSMDVASVFVDGGNQL

SEQ ID NO: 777208 - protein, 117 aa, Homo sapiens
FLRWSLTLLPRLECNSTISDHCNLCFSGSSDSRASASQVNGIIGACHHTQLIFLFLVEMGFYRVGQAGLELLTSDDLPASASQSAGIYRREPPCPAPEKHFDEKKTDSENINSGLVT

SEQ ID NO: 777209 - protein, 97 aa, Homo sapiens
PAILSEMEKGMTGRADQEDGNSTRHWELQTPTILSEMEKGMAMADTKCYSTFITGLNGEHDAIKPLDKNTGKFVWPGVGRKVLRHDTKSMIHKRLTN

SEQ ID NO: 777210 - protein, 103 aa, Homo sapiens
EKEEEDASGSVWLTEPRLLTPGPSAGRDLAGALGAFELLSFFISDFQHCIFQVPWWAFLCVLLSICCFLDLSVVFIIFGRFLAITQMSFSTTASSSSCWTVAL

SEQ ID NO: 777211 - protein, 397 aa, Homo sapiens
MFFGGEGSLTYTLGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 777212 - protein, 431 aa, Homo sapiens
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 777213 - protein, 246 aa, Homo sapiens
SGTILKAAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 777214 - protein, 111 aa, Homo sapiens
GRANVAGKQLRVAGQERALPPRQTCRRCDGSRNLLTTKPARPVRELRSIRCGPRRDPRADSPVLPAGATELSSHLDGSRGAGVLSTPERNLIICAAFLKQTKTRGRIILDL

SEQ ID NO: 777215 - protein, 431 aa, Homo sapiens; identical to SEQ ID NO: 777212

SEQ ID NO: 777216 - protein, 365 aa, Homo sapiens
MLMKPFIAGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 777217 - protein, 108 aa, Homo sapiens
DGSRNLLTTKPARPVRELRSIRCGPRRDPRADSPVLPAGATELSSHLDGSRGAGVLSTPGKGVSPIPTPDRPQATSLPAERVGPLLSRGRGSFTHTRASKGPAGANKG

SEQ ID NO: 777218 - protein, 106 aa, Homo sapiens
LEDTRRGFPEKILNESLRQRFPSQALHHIPSAAQCLRASPARKPSPETPPETGSGPGEEASLEGTSSKRAASYLLPSSDTGGRHPPGRFLHPPLLLWVWSHWENKG

SEQ ID NO: 777219 - protein, 62 aa, Homo sapiens
KSKSCVWQMVCLWMEILPPHSQEMEADITFNTGLLGNGVGSEARIYTRKFQIDGWLSLPFWK

SEQ ID NO: 777220 - protein, 181 aa, Homo sapiens
DQWKRALLVAKRTLGGKMAAAGEGTPSSRGPRRDPPRRPPRNGYGVYVYPNSFFRYEGEWKAGRKHGARDSCNLTMAVITKGRCGRTEITGDGRGTWAWSRRHLLWTRCTAKSPSTGYGVQESTKPAECPETGGLPGEWGKGNEDNGGHEMEQRPRTPPGQPRHRTGQITPKRDKTTPPAP

SEQ ID NO: 777221 - protein, 104 aa, Homo sapiens
ETDSRSVTQARVQWCDLSSVQPLPLGFKRFSCLSLPCSWDYRSPPTCPADFSVLVEMRFYHVNQVGVELTSSDLPTLASQSAGITGVSHHAQPGSPFLWPNTIP

SEQ ID NO: 777222 - protein, 369 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQSDPWLSLQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777223 - protein, 331 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777224 - protein, 341 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777225 - protein, 311 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777226 - protein, 313 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777227 - protein, 134 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGVLQEVEGHQEHPSCLVQQIQPTLVITCIL

SEQ ID NO: 777228 - protein, 107 aa, Homo sapiens
MPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777229 - protein, 134 aa, Homo sapiens; identical to SEQ ID NO: 777227

SEQ ID NO: 777230 - protein, 361 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777231 - protein, 369 aa, Homo sapiens; identical to SEQ ID NO: 777222

SEQ ID NO: 777232 - protein, 357 aa, Homo sapiens
MLVIPSALMYSFVLYWRLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777233 - protein, 287 aa, Homo sapiens
MRWVLRDVNTHHKHEVFHEYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 777234 - protein, 361 aa, Homo sapiens; identical to SEQ ID NO: 777230

SEQ ID NO: 777235 - protein, 361 aa, Homo sapiens; identical to SEQ ID NO: 777230

SEQ ID NO: 777236 - protein, 91 aa, Homo sapiens
MYGKGKSNSSAVPSDSQAREKLALYVYEYLLHVGAQKSAQTFLSEIRWEKNITLGEPPGFLHSWWCLLDDLNLLTSWICPPRPPKLLGLQA

SEQ ID NO: 777237 - protein, 88 aa, Homo sapiens
FANGKLLLILQNPALIASCFCNASEQHYLPSLLSFSSMLFSDMTVNPLSVMSLHQITFRDGTHNLSKLLIHKHSSYSRHSGRSGFQPQ

SEQ ID NO: 777238 - protein, 319 aa, Homo sapiens
PGGDRVEPWLEENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPETPPSSCDSNNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 777239 - protein, 319 aa, Homo sapiens; identical to SEQ ID NO: 777238

SEQ ID NO: 777240 - protein, 319 aa, Homo sapiens; identical to SEQ ID NO: 777238

SEQ ID NO: 777241 - protein, 319 aa, Homo sapiens; identical to SEQ ID NO: 777238

SEQ ID NO: 777242 - protein, 84 aa, Homo sapiens
PGGDRVEPWLEGCCEVSVDNGKRLAQETDHYNPWLCLLSPVEEPGPSPCTPDIQGRGVRKTLPPNGLDGMFPSSCSPNVSTGAH

SEQ ID NO: 777243 - protein, 319 aa, Homo sapiens; identical to SEQ ID NO: 777238

SEQ ID NO: 777244 - protein, 319 aa, Homo sapiens; identical to SEQ ID NO: 777238

SEQ ID NO: 777245 - protein, 319 aa, Homo sapiens; identical to SEQ ID NO: 777238

SEQ ID NO: 777246 - protein, 319 aa, Homo sapiens; identical to SEQ ID NO: 777238

SEQ ID NO: 777247 - protein, 412 aa, Homo sapiens
CVFVCFILQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGHHGHPFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 777248 - protein, 420 aa, Homo sapiens
TAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGHHGHPFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 777249 - protein, 420 aa, Homo sapiens; identical to SEQ ID NO: 777248

SEQ ID NO: 777250 - protein, 420 aa, Homo sapiens; identical to SEQ ID NO: 777248

SEQ ID NO: 777251 - protein, 208 aa, Homo sapiens
TAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGTIYSCAIPQPLPSCCPRRTGRARGQPPAFESSRCLCSHNSDLSGRAQKS

SEQ ID NO: 777252 - protein, 107 aa, Homo sapiens
SIAAKGEVRLAHGDGLHSAGKLVDQPAQSEDGDSQASAQPEIWAYRVLSAFLLGSSTRCLLPSPANISFLVLRHSLSSSSTWYEHSQESVDEDDFPLLGTFAVYLPG

SEQ ID NO: 777253 - protein, 46 aa, Homo sapiens
MTGTLAASWPWASRGHVPLVKVITSVGQVSRAAKATALPGSINCPL

SEQ ID NO: 777254 - protein, 155 aa, Homo sapiens
KFIPPNYHTPPYLTAEPEVTYHRLRPQDKFLVLATDGLWGTMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 777255 - protein, 155 aa, Homo sapiens; identical to SEQ ID NO: 777254

SEQ ID NO: 777256 - protein, 53 aa, Homo sapiens
MGSNETDQRFPILSIISILWETFIRIQIPEPCFRFLNSEFPELSLLNVNCFQA

SEQ ID NO: 777257 - protein, 325 aa, Homo sapiens
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRGPTVPKKNGWTLKQIMRSWLMTARQEGTNEKICWKVMASATNVAWWAGLERMRRDRGTDGTRKLEDQLPAKKPTRGPQARHASLDSEAETNKRDPKRTRLPGIEKGENQPPRDVNKNNKQQTVANREKASTPHNERVAKTENHTTGRKAPTTNSRPTPRQEEGDHHRKQKEN

SEQ ID NO: 777258 - protein, 102 aa, Homo sapiens
GFQCPVSVASGHKHSWPALACRLAVSQSVQPLSPLPGGSYSPPSAVFCHYPGGRGWSAIQEHLVSSMGKRQHREQDHTKLAGTSKLLSPFPRKPQESFFEFL

SEQ ID NO: 777259 - protein, 56 aa, Homo sapiens
PTGRPPRERGHVCSSLLRAPEGRGFPFPAPLAFAVKSRSPPAARGSLTAQQHPQPG

SEQ ID NO: 777260 - protein, 111 aa, Homo sapiens
YLFKGGANAGATQWLLPWIKSACGDISSLILGHRPLKLSCGRGWKFLFFSANLILLYKMRLVSLPFNLENKFNNNLTFSLPVTKGERLLFAARMNRAEFQRLVGRKLLFIR

SEQ ID NO: 777261 - protein, 1229 aa, Homo sapiens
TIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRACELCIRAAIEQSMKEGEELLSDCYRGVVFDGLDTLFARNAAAALLCLLKAIGSREHIYILNMAQDYAAMKAREKAKKEQEERKHKGALEKEKEGLQNMDEEEYDALTEEEKLTFDRGIQQALRERKKREQERLAKEMQEKKLQQELERQKEEDELKRRVKKGKQGPIKEEPPMKKSQAANKQLLCAEFLLCDISLLGTVNRSHHHLSPVSTTPAEGDMIITIILEMRKLECSTVPPLTKVDVKMETIERKISVREQTMSEKEELNKKKRNMGDVSMHGLPLVQDQEDSEGDISKDPDKQLAQKFKTYELTLKDVQNILMYWDRKQGVQLPPAGMEEAPHEPDDQRQVPSGGRRGRKDRERERLEKERLEREEAERERLEKLRALEERSDWEGEGEEDHEEKKEKDLGVPFLNIQTPDFEGLSWKQALESDRLPKGEQAQEEQTSSSKGGKQKMKEKIDQVFESQKDKRHMALNRKVLSGEPAGTISQLSDTDLDNFNGQHSQEKFTRLNHFRWIVPANGEVTLQVHFSSDEFGNFDQTFNFEILGTCCQYQLYCRGICTYPYICQDPKVVFPQRKMDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRQESRVVLLRNVTLLPVAWRITSLEHLGDDFTVSLMQGTIPPEAEYGLHLYFQPTKPVNIKKAIRLEVLDAENLLGVVQIENIMVFAEAYDIALDITFPKGAEGGLDFGIVRVTEEAKQPLQLKNRGKYEIAFR

SEQ ID NO: 777262 - protein, 268 aa, Homo sapiens
GAAGPWRGTLREELGTATLGEVLDAENLLGVVQIENIMVFAEAYDIALDITFPKGAEGGLDFGIVRVTEEAKQPLQLKNRGKYEIAFSFSVDSVGISTPNINSMISVQPKKGSLTPTEKPRNVQVFFHAKKEVKIEHQPVLRCQIIEPNISEGGEIIASIPIKFSANAVYSKYNITPSSVINFGALICGTRKSTTFTIENQGVTDFKFALYKLTGESPIHQKKAASHVRHARSRESESFYKTGSSRAAKFSDTIQKEVTTTGQVRVLF

SEQ ID NO: 777263 - protein, 153 aa, Homo sapiens
YGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLG

SEQ ID NO: 777264 - protein, 67 aa, Homo sapiens
NPWVFTKGEVQDHPRTAQLLPCQRGKVRYRGVFGRSPFFCLLLPHPTPSGGNKQASIHELNKKVSLA

SEQ ID NO: 777265 - protein, 288 aa, Homo sapiens [sequence omitted]

SEQ ID NO: 777266 - protein, 244 aa, Homo sapiens
MELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLLQSMGHLADHSMAQTLQASLEGLPPSTSSGQPPLQDMLCLGGVAVSLSHIRN

SEQ ID NO: 777267 - protein, 229 aa, Homo sapiens
MELLEKMLALTLAKADSPRTALLCSAWLLTASFSAQQHKGSLQVHQTLSVEMDQVLKALSFPKKKAAYSQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 777268 - protein, 298 aa, Homo sapiens
MQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAAYSQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 777269 - protein, 117 aa, Homo sapiens
ASCLVFPLYLWPFLRKTLSLNGLNCHSLFLPQMFSCLEYWFIFLYLLYFLIVCNVQPNSLLNIAFIHISKAREIFFSIVYHFTCAIPVKQADSGSSEEKQLYNKYPDAVATWVKPTH

SEQ ID NO: 777270 - protein, 32 aa, Homo sapiens
MGLQACCDPLGKVSPMATCPVPRSCAVRIPGG

SEQ ID NO: 777271 - protein, 72 aa, Homo sapiens
TTVLQRLLQEQLRYGNPSENRSLLAIHQQATGNGPPFPSGSGNPGPQSDVLSPQDHHQQLVAHAARQEPQGQ

SEQ ID NO: 777272 - protein, 149 aa, Homo sapiens
MSFLLPKLTSKKEVDQAIKSTAEKVLVLRFGRDEDPVCLQLDDILSKTSSDLSKMAAIYLVDVDQTAVYTQYFDISYIPSTVFFFNGQHMKVDYGSPDHTKFVGSFKTKQDFIDLIEVIYRGAMRGKLIVQSPIDPKNIPKYDLLYQDI

SEQ ID NO: 777273 - protein, 149 aa, Homo sapiens; identical to SEQ ID NO: 777272

SEQ ID NO: 777274 - protein, 149 aa, Homo sapiens; identical to SEQ ID NO: 777272

SEQ ID NO: 777275 - protein, 131 aa, Homo sapiens
MSFLLPKLTSKKEVDQAIKSTAEKVLVLRFGRDEDPVCLQLDDILSKTSSDLSYFDISYIPSTVFFFNGQHMKVDYGSPDHTKFVGSFKTKQDFIDLIEVIYRGAMRGKLIVQSPIDPKNIPKYDLLYQDI

SEQ ID NO: 777276 - protein, 149 aa, Homo sapiens; identical to SEQ ID NO: 777272

SEQ ID NO: 777277 - protein, 435 aa, Homo sapiens
ERERDRRGEKESKTEDRHSETGREGERETKTETETERKKETDRQTAQAEKESKTEDRHSESRHAERERETETERDRERQRERHARQTEQAGCATSEQRTPHQIAQRASRSARKRGNNEAEQTQEPQNTTDRETRQHTQRPARRATAGAEEEEKSPRSQRGQEKGTQHKHERHDTMRAERRRGREKGAGQEASKRKGKEERRKEEESTGRTRGKRGGAGRRKTRGRDDGEKKREDESRGEEKREKERETSEGAREQRKHERRGERGRGGQASRRGEERSSERTRGQRGNGTAAAGEGRRDERRRAGEKGGSAEDGEWGGTGDRARGGRGSEEEHRGERRRARKTGTHDDNGEERETAVRGGRKGDRENGRRDSGSDEEREQRRGEREEEREKRAEKKRDGGKEGAEGGRREQQGRGRGERGEVGRGDGGREHGGQR

SEQ ID NO: 777278 - protein, 113 aa, Homo sapiens
NNLKQFFSEMLFSSWFVRTTFLQGWARMLCPEQLHLLCQQQPSSLCGKHASPRQHPVDSWPRGLSGSYFGLGRGSANWLLCFSSCEKSFQGSSSDNHHLDLKCKYCHRGLKRD

SEQ ID NO: 777279 - protein, 68 aa, Homo sapiens
PQSPNSAQSKRIVGQIIPAIATTTAAVAGLLGLELYKVVSGPRPRSALPKPLQLRSDRNGTQIQAYVT

SEQ ID NO: 777280 - protein, 113 aa, Homo sapiens
HQPGSHTAHTQNTQLTPGTHSLHPGNTAHTRDTQLTPGTQSSHPGHTAHTQDTLSSHLIQGQLTVEHTAHTRDTAHTQDTLSSHWNTQLTPRTQNSHLGHTQLTPETHTLTPS

SEQ ID NO: 777281 - protein, 177 aa, Homo sapiens
QRIHTGEKLYKCKACSKCFTHSSNLLVHQRIHTGEKPYKCKECGKSFKVSSALTQHERIHTGEKPYKCKECSKAFNCSSSLTKHQRIHTGVKLYKCKACSKSFSHSSCLSVHQITHTGMKPYICKDCGISFNRSSNLRRHQMIHTGEKPYKCKECGKLFNRCSTLTRHKSIHTREFL

SEQ ID NO: 777282 - protein, 103 aa, Homo sapiens
MLSSAFGQDRSLRPEEIEELREAFREFDKDKDGYINCRDLGNCMRTMGYMPTEMELIELSQQINMNLGGHVDFDDFVELMGPKLLAETADMIGVKELRDAFRE

SEQ ID NO: 777283 - protein, 728 aa, Homo sapiens
EAPPLWMVTAPPPGFLLEEFPSQPGRPRSQMVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 777284 - protein, 581 aa, Homo sapiens
EAPPLWMVTAPPPGFLLEEFPSQPGRPRSQMVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPG

SEQ ID NO: 777285 - protein, 116 aa, Homo sapiens
LNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQM

SEQ ID NO: 777286 - protein, 43 aa, Homo sapiens
MSWGLEMSWQSLEAPRLVNDGTEGIPSLRLYSSCVSKADPALW

SEQ ID NO: 777287 - protein, 224 aa, Homo sapiens
RQTRPLSKASASECPARDVPGQGTPVSTEPRAACSLPQWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGH

SEQ ID NO: 777288 - protein, 362 aa, Homo sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 777289 - protein, 69 aa, Homo sapiens
LRGYVLKGRPKCWARNFIGHIKVDPQPLAPFEEAAFVHRGTTSDQSKSLKIYRNYIHWAVWYSTDFFHN

SEQ ID NO: 777290 - protein, 84 aa, Homo sapiens
FALNLKQNKGRNYTFWVAAPCKCIRMQVCEQRHGRQNHRQAAGLLQPPPRCRGAFPAPLRSAAEATPWLSAEEEPPWGTVGSEA

SEQ ID NO: 777291 - protein, 81 aa, Homo sapiens
PMRHLSQVELRCLQLTQASVTLWWLYRSGVFRGSPTPTISLGFAIVGAIGVGLDPITSLDIALVMVTGGSQMPRQIKVGPW

SEQ ID NO: 777292 - protein, 59 aa, Homo sapiens
METSSKGLLTQVTQFWNLLDDLAQSDPEGYEKFIQQQLKEGKQLCAAPEPQLCLQTRIL

SEQ ID NO: 777293 - protein, 118 aa, Homo sapiens
MASWPHLRQQPLWLGSPAGWVHPRPSDGSNQNRWAAVTSTVSSILAATRLGVQALSWTLEVGPHTELCSAPSPPSFIAQTTARDPAPHVPYPALTSSPVQPQHRGLPGGGCGLMLGIS

SEQ ID NO: 777294 - protein, 102 aa, Homo sapiens
VIPALWEAEFTFSPFSQDVPEMTLVTKHLFFPISLPGWCGYLLQVHSVLWWDPYGQGTWSQLNILGQMRMEVNRHSLTLKNLLSNRRAKKQGYNSDLPVSSM

SEQ ID NO: 777295 - protein, 348 aa, Homo sapiens
NDKQRIAVVAFFPENGVSDFQKAQIIGSQRENGWAVGVESDFDFCQTAIKRIFNDSDFTGFLTVEYGTILSSANSINWGRLLPQVVYHASAYLDLVSQGFISFGSPVDVCIPTGNFGNILAAVYAKMMGIPIRKFICASNQNHVLTDFIKTGHYDLRERKLAQTFSPSIDILKSSNLERHLHLMANKDGQLMTELFNRLESQHHFQIEKALVEKLQQDFVADWCSEGECLAAINSTYNTSGYILDPHTAVAKVVADRVQDKTCPVIISSTAHYSKFAPAIMQALKIKEINETSSSQLYLLGSYNALPPLHEALLERTKQQEKMEYQVCAADMNVLKSHVEQLVQNQFI

SEQ ID NO: 777296 - protein, 348 aa, Homo sapiens; identical to SEQ ID NO: 777295

SEQ ID NO: 777297 - protein, 68 aa, Homo sapiens
AECLVQGHATGKRRSLQSQDSASCVSRSPGGMWGLMLAPPLASLTDGHREGRDWGHGNRFGSLSSIPR

SEQ ID NO: 777298 - protein, 141 aa, Homo sapiens
AKWTRELLHLLGEKNQTELDSFLSLAGRTCMDEMTFHILSVPVPQTLGFPIFTLSCLGHPFYWLKSYLCTKSKDSPSFRKSLTVPRRLFPPSSKCPEGWHWIAFAMGFCCRECRPRLLKGRPCIQHAGEMQHLAQALHTQV

SEQ ID NO: 777299 - protein, 68 aa, Homo sapiens
MRYNASVSCAELATQSKNLPETWHALREHQDAAQWPHTPSQLTGTTLSKTLPAASQHLAPGTPAPATP

SEQ ID NO: 777300 - protein, 140 aa, Homo sapiens
MSSYFVNSTFPVTLASGQESFLGHVPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSE

SEQ ID NO: 777301 - protein, 113 aa, Homo sapiens [sequence omitted]

SEQ ID NO: 777302 - protein, 36 aa, Homo sapiens
MQADTLRSTVTQGQCGEIEEGLEGGGPRSHRGWRQV

SEQ ID NO: 777303 - protein, 281 aa, Homo sapiens
SSLFIYKNSGESYQAPDPGNGSIQRPYQDTVAENKDALEKTQTYLKVHSNLVIPDVELETYIPYSTPTLTPSDTFQTVETLTCLSLERNRLTDYYEPLLKNNSTAYSTRGNRIEISYENLQVTNITRKGSMLPVSCKLPNMGTYQSYLSSSMPAGCVLPVGGNFEILLHYYLLNYAKKCHQSEETMVSMIIANALLGIPKVLYKSKTGKYSFPHTYIRAVHALQTNQPLVSSQTGLESVMGKYQLLTSVLQCLTKILTIDMVITVKRHPQKVHNQDSEDEL

SEQ ID NO: 777304 - protein, 281 aa, Homo sapiens; identical to SEQ ID NO: 777303

SEQ ID NO: 777305 - protein, 217 aa, Homo sapiens
TQAQRRPARAERRQLLCGLRARAPLSANGREARAMEQRLAEFRAARKRAGLAAQPPAASQGAQTPGEKAEAAATLKAAPGWLKRFLVWKPRPASARAQPGLVQEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 777306 - protein, 217 aa, Homo sapiens; identical to SEQ ID NO: 777305

SEQ ID NO: 777307 - protein, 217 aa, Homo sapiens; identical to SEQ ID NO: 777305

SEQ ID NO: 777308 - protein, 178 aa, Homo sapiens
TQAQRRPARAERRQLLCGLRARAPLSANGREARAMEQRLAEFRAARKRAGLAAQPPAASQGAQTPGEKAEAAATLKAAPGWLKRFLVWKPRPASARAQPGLVQMKEYRNSRIFAQWNTLQPSNFRTSPHFQQRGERPVHPQMKGYRNCSIHSQWNTLQLCTYTEIISPGATQLNLFIP

SEQ ID NO: 777309 - protein, 178 aa, Homo sapiens; identical to SEQ ID NO: 777308

SEQ ID NO: 777310 - protein, 195 aa, Homo sapiens
TQAQRRPARAERRQLLCGLRARAPLSANGREARAMEQRLAEFRAARKRAGLAAQPPAASQGAQTPGEKAEAAATLKAAPGWEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 777311 - protein, 217 aa, Homo sapiens; identical to SEQ ID NO: 777305

SEQ ID NO: 777312 - protein, 108 aa, Homo sapiens
TQAQRRPARAERRQLLCGLRARAPLSANGREARAMEQRLAEFRAARKRAGLAAQPPAASQGAQTPGEKAEAAATLKAAPGWLKRFLVWKPRPASARAQPGLVQLKNNV

SEQ ID NO: 777313 - protein, 178 aa, Homo sapiens; identical to SEQ ID NO: 777308

SEQ ID NO: 777314 - protein, 108 aa, Homo sapiens; identical to SEQ ID NO: 777312

SEQ ID NO: 777315 - protein, 123 aa, Homo sapiens
MTVMVVLHGAGGCFKQIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777316 - protein, 78 aa, Homo sapiens
DCCPDGTAALQGGRKGYRLQTTPKSSPHSDYLCWNDTIPNVWGHQCEAGADGGPHELSAMLCGSLGRHTVSTSGTWAH

SEQ ID NO: 777317 - protein, 77 aa, Homo sapiens
FYGRVSFRYKQDKRSTDYTATPKSSPHSDYLCWNDTIPNVWGHQCEAGADGGPHELSAMLCGSLGRHTVSTSGTWAH

SEQ ID NO: 777318 - protein, 73 aa, Homo sapiens
PETLTINHKQKEQKPTTPKSSPHSDYLCWNDTIPNVWGHQCEAGADGGPHELSAMLCGSLGRHTVSTSGTWAH

SEQ ID NO: 777319 - protein, 819 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777320 - protein, 494 aa, Homo sapiens
MRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777321 - protein, 839 aa, Homo sapiens
LVPVRTVFWMTAVAQGSASPMDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777322 - protein, 774 aa, Homo sapiens
VRGSREGAQEYGDSASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777323 - protein, 730 aa, Homo sapiens
MGDDSIIHALGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777324 - protein, 473 aa, Homo sapiens
YYNLGPSNRTSNDQNGLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777325 - protein, 374 aa, Homo sapiens
ADLEVPGRLSVQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777326 - protein, 776 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEQLRSQARTLITFAGMIPYRTSGDTNARLVQMEVLMN

SEQ ID NO: 777327 - protein, 778 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEVSSFFLSCGIPFSPLPPKAFSFPVPNSFKNSSYSNYPD

SEQ ID NO: 777328 - protein, 598 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGETRRMTERRKPWR

SEQ ID NO: 777329 - protein, 116 aa, Homo sapiens
APGQAEASCCWMKGLGMASMPSCGQISTTDVPRHTTRPSCRVSSVSLYWSSGSRMYSMVPSSTRLRSGSKPFRIPLALVPNSARGRAAREAAAASSSRHLSGGDGCSTRICISNGY

SEQ ID NO: 777330 - protein, 165 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEVA

SEQ ID NO: 777331 - protein, 81 aa, Homo sapiens
RLLFRERAVPQTRKDFKLTRLALPTPKSSPHSDYLCWNDTIPNVWGHQCEAGADGGPHELSAMLCGSLGRHTVSTSGTWAH

SEQ ID NO: 777332 - protein, 73 aa, Homo sapiens
MENKETRQERVVKAPTTPKSSPHSDYLCWNDTIPNVWGHQCEAGADGGPHELSAMLCGSLGRHTVSTSGTWAH

SEQ ID NO: 777333 - protein, 819 aa, Homo sapiens; identical to SEQ ID NO: 777319

SEQ ID NO: 777334 - protein, 696 aa, Homo sapiens
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777335 - protein, 696 aa, Homo sapiens; identical to SEQ ID NO: 777334

SEQ ID NO: 777336 - protein, 798 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 777337 - protein, 819 aa, Homo sapiens; identical to SEQ ID NO: 777319

SEQ ID NO: 777338 - protein, 794 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSCTPLATEYVIM

SEQ ID NO: 777339 - protein, 719 aa, Homo sapiens [sequence omitted]

SEQ ID NO: 777340 - protein, 78 aa, Homo sapiens
HTQQHSERVRNQHTKFQGDEATPKSSPHSDYLCWNDTIPNVWGHQCEAGADGGPHELSAMLCGSLGRHTVSTSGTWAH

SEQ ID NO: 777341 - protein, 114 aa, Homo sapiens
MDTEGFGELLQQAEQLAAETEGISELPHVERNLQEIQQAGERLRSRTLTRTSQETADVKAVVNEKYQYRTFGMAEEYHRESMLVEWEQVKQRILHTLLASGEDALDFTQESEVA

SEQ ID NO: 777342 - protein, 184 aa, Homo sapiens
TSAAEQPPSPLGREPGGPPGSFLTSRRPRLPLTVPFPPTWAEDPGPAYGDASGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSLLLPLPFHCCFLCIAP

SEQ ID NO: 777343 - protein, 968 aa, Homo sapiens
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 777344 - protein, 835 aa, Homo sapiens
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 777345 - protein, 968 aa, Homo sapiens; identical to SEQ ID NO: 777343

SEQ ID NO: 777346 - protein, 968 aa, Homo sapiens; identical to SEQ ID NO: 777343

SEQ ID NO: 777347 - protein, 271 aa, Homo sapiens
MATMSLFTVSMNRLLLILIVWLICRVHRYGESNHSRSAHVETALIDVWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 777348 - protein, 916 aa, Homo sapiens
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCR

SEQ ID NO: 777349 - protein, 97 aa, Homo sapiens
KMTSFDSMCHIQVMQEVGSQGLGQPRPPQTSLVKFVGNIYTLKCRFCEVEFQGPLSIQEEWVRHLQRHILEMNFSKADPPPEESQAPQAQTAAAEAP

SEQ ID NO: 777350 - protein, 184 aa, Homo sapiens; identical to SEQ ID NO: 777342

SEQ ID NO: 777351 - protein, 968 aa, Homo sapiens; identical to SEQ ID NO: 777343

SEQ ID NO: 777352 - protein, 968 aa, Homo sapiens; identical to SEQ ID NO: 777343

SEQ ID NO: 777353 - protein, 897 aa, Homo sapiens
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINSECLVEEGRERSGHLSGPPSHSPGALLWPLSPFSSCLPIHPSIPHPT

SEQ ID NO: 777354 - protein, 100 aa, Homo sapiens
SGPTQPANGFDLACTEIFFYHASITSIETSEDVTQKPAPYSLNIRRAATRAHNPSWQQQAKTENSCRVGQARAPGVTAGPICPLLSLTWPAQTLEASELE

SEQ ID NO: 777355 - protein, 153 aa, Homo sapiens
MALVFVYGTLKRGQPNHRVLRDGAHGSAAFRARGRTLEPYPLVIAGEHNIPWLLHLPGSGRLVEGEVYAVDERMLRFLDDFESCPALYQRTVLRVQLLEDRAPGAEEPPAPTAVQCFVYSRATFPPEWAQLPHHDSYDSEGPHGLRYNPRENR

SEQ ID NO: 777356 - protein, 153 aa, Homo sapiens; identical to SEQ ID NO: 777355

SEQ ID NO: 777357 - protein, 153 aa, Homo sapiens; identical to SEQ ID NO: 777355

SEQ ID NO: 777358 - protein, 153 aa, Homo sapiens; identical to SEQ ID NO: 777355

SEQ ID NO: 777359 - protein, 256 aa, Homo sapiens
MKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 777360 - protein, 235 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 777361 - protein, 478 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 777362 - protein, 215 aa, Homo sapiens
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 777363 - protein, 458 aa, Homo sapiens
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 777364 - protein, 383 aa, Homo sapiens
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 777365 - protein, 47 aa, Homo sapiens
APSQILQGTLKAHQMWLQTHLPQTLSSGSRGFSSHPIRICSPRTSFA

SEQ ID NO: 777366 - protein, 262 aa, Homo sapiens
QFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVPNWTVTFEN

SEQ ID NO: 777367 - protein, 194 aa, Homo sapiens
VFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVCNQMFMHFNFSVEIIL

SEQ ID NO: 777368 - protein, 49 aa, Homo sapiens
GTPPNVFPRNQSYSLLHNSGPCSRRTVPNFLHPKAFQRMKTSFKDISRT

SEQ ID NO: 777369 - protein, 114 aa, Homo sapiens
FSTFSAMDFLGLGVLKPHPMIGVCGQGGEAYSAGCSQQRPLAQSFCRSRQGACTSRLPPPMALDNDTLGKTYIYQWAQKISFCFCSGCFCVGKEIPSFFIEAQNQQNCSSTWPF

SEQ ID NO: 777370 - protein, 107 aa, Homo sapiens
LSVPERETVKECVTIHAYEADACTPRPPAPWCGFQALGGLQGDLPGKGWETPKGGDWGKGQPTPGAKNYGMLPGQGPWGPMSKQGCGELELTRPPLGPHLAPGRCSC

SEQ ID NO: 777371 - protein, 34 aa, Homo sapiens
PENQSSSALIFHSDIGHSYSRLTYGSFLVCHSAF

SEQ ID NO: 777372 - protein, 111 aa, Homo sapiens
MGMCWVKVEGKNAENHHIRERDFTALGKEATGKGSCFISFFRRVRPFLLSFVATGHHKTGASLSDGSRTASDVRAARRSRSPQQGPLTTWEFWKSARPALPQALLGLQKNS

SEQ ID NO: 777373 - protein, 113 aa, Homo sapiens
EFFCIRDWSLLCVYMHACMYVSMDIYLFYTLDYNLILVYFIDQTVVALAMEALSVGYCVPLIYPHCCIVVVFEYFLNFWHYKMLMHILYIPCSSARINDFFQGALVSFIGDCY

SEQ ID NO: 777374 - protein, 130 aa, Homo sapiens
MVGPGRQSEHLVERLLNPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSD

SEQ ID NO: 777375 - protein, 198 aa, Homo sapiens
IGSHNSETPPSNPTFRSTPDTMACCQTSFCGFPSCSTSGTCGSSCCQPSCCETSSCQPRCCETSCCQPSCCQTSFCGFPSFSTGGTCDSSCCQPSCCETSCCQPSCYQTSSCGTGCGIGGGIGYGQEGSSGAVSTRIRWCRPDCRVEGTCLPPCCVVSCTPPSCCQLHHAEASCCRPSYCGQSCCRPVCCCYCSEPTC

SEQ ID NO: 777376 - protein, 86 aa, Homo sapiens
IGSHNSETPPSNPTFRSTPDTMAAARPASVDFLASQPVGLVTLAAASQAAVKLAAASQAATRPAPAELAVALVVALAMARRAAVEL

SEQ ID NO: 777377 - protein, 85 aa, Homo sapiens
MACCQTSFCGFPSCSTSGAVSTRIRWCRPDCRVEGTCLPPCCVVSCTPPSCCQLHHAEASCCRPSYCGQSCCRPVCCCYCSEPTC

SEQ ID NO: 777378 - protein, 136 aa, Homo sapiens
MEQSCEEEKEPEPQKNIQETKQVDDEDAELIFVGVEHVNEDAELIFVGVTSNSKPVVSNILNRVTPGSWSRRKKYDHLRKDTARKLQPKSHETVTSEAVTVLPASQLESRSTDSPIIIEPLSKPDYRNSFPQVVPN

SEQ ID NO: 777379 - protein, 104 aa, Homo sapiens
MSGVPFEYWFLNISSLGCLCGLPELSPCLCSGAILCSSTPDQGAQQPVFTSQGIRHLGCSIHRSGEISPFFLDFFLKVPYLSPLLSSLLNLVKFPKLSQKSGKR

SEQ ID NO: 777380 - protein, 277 aa, Homo sapiens
ASSAPLLPRATPGLRTLAPDLLGGAPRSSHQPGWVSWLGLGAPGVNVQPGVCGDAIRGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 777381 - protein, 228 aa, Homo sapiens
MQSLPNSNGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 777382 - protein, 185 aa, Homo sapiens
MKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 777383 - protein, 185 aa, Homo sapiens; identical to SEQ ID NO: 777382

SEQ ID NO: 777384 - protein, 185 aa, Homo sapiens; identical to SEQ ID NO: 777382

SEQ ID NO: 777385 - protein, 123 aa, Homo sapiens
LEERSHLGNSLLLALPPSQGLPSAHLAQPLNGLVPGPLESSKAFWYCLWVFLSSETGSGELQFGKCIRAEDKVCAVLSGTEAQSRGAKGFGWVPFLSPACSETETNSFSRYQFPLCKNVGQAR

SEQ ID NO: 777386 - protein, 147 aa, Homo sapiens [sequence omitted]

SEQ ID NO: 777387 - protein, 249 aa, Homo sapiens
LFAVAFNLVKSYMSEETRRKVVILGDNWKQELTKFISPDQLPVEFGGTMTDPDGNPKCLTKINYGGEVPKSYYLCKQVRLQYEHTRSVGRGSSLQVENEILFPGCVLRFLRFYNTYSLVHSKRISYTVEVLLPDQTFMEKMEKFYVNLMVPTPSSLISESTMSSQPSLARPCSTSQEQGFYNSRSQPMHHSWPTPQERLGQCPSGGPMVTAKQHRHSIPTMTCCDLKLSKNPRLFSINQYQEISYSSKI

SEQ ID NO: 777388 - protein, 32 aa, Homo sapiens
MGGAAATEAAARTRRGRRDGGSAASAHLFLGK

SEQ ID NO: 777389 - protein, 121 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPR

SEQ ID NO: 777390 - protein, 85 aa, Homo sapiens
MSGGGVIRGPAGNNDCRIYVGNLPPDIRTKDIEVKLPMSGGGVIRGPAGNNDCRIYVGNLPPDIRTKDIEDVFYKYGTSWPRREQ

SEQ ID NO: 777391 - protein, 304 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSRT

SEQ ID NO: 777392 - protein, 309 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSHISEEMD

SEQ ID NO: 777393 - protein, 304 aa, Homo sapiens; identical to SEQ ID NO: 777391

SEQ ID NO: 777394 - protein, 304 aa, Homo sapiens; identical to SEQ ID NO: 777391

SEQ ID NO: 777395 - protein, 304 aa, Homo sapiens; identical to SEQ ID NO: 777391

SEQ ID NO: 777396 - protein, 304 aa, Homo sapiens; identical to SEQ ID NO: 777391

SEQ ID NO: 777397 - protein, 304 aa, Homo sapiens; identical to SEQ ID NO: 777391

SEQ ID NO: 777398 - protein, 298 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEADRFPDVLPASATDPNCRTSHSSPRPPGSIQWGISSKRNQTNVFQPLHSVASLCVRKG

SEQ ID NO: 777399 - protein, 298 aa, Homo sapiens; identical to SEQ ID NO: 777398

SEQ ID NO: 777400 - protein, 292 aa, Homo sapiens
SFRARAALGAMSCGRPPPDVDGMITLKVDNLTYRTSPDSLRRVFEKYGRVGDVYIPREPHTKAPRGFAFVRFHDRRDAQDAEAAMDGAELDGRELRVQVARYGRRDLPRSRQGEPRGRSRGGGYGRRSRSYGRRSRSPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARRSKSSSVSRSRSRSRSSSMTRSPPRVSKRKSKSRSRSKRPPKSPEEEGQMSS

SEQ ID NO: 777401 - protein, 78 aa, Homo sapiens
PFYFLRSRRDAEDAVYGRDGYDYDGYRLRVEFPRSGRGTGRGGGGGGGGGAPRGRYGPPSRRSENRVVVSGECTGCVD

SEQ ID NO: 777402 - protein, 304 aa, Homo sapiens; identical to SEQ ID NO: 777391

SEQ ID NO: 777403 - protein, 304 aa, Homo sapiens; identical to SEQ ID NO: 777391

SEQ ID NO: 777404 - protein, 304 aa, Homo sapiens; identical to SEQ ID NO: 777391

SEQ ID NO: 777405 - protein, 304 aa, Homo sapiens; identical to SEQ ID NO: 777391

SEQ ID NO: 777406 - protein, 257 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEVGYTRILFFDQNWIQWS

SEQ ID NO: 777407 - protein, 257 aa, Homo sapiens; identical to SEQ ID NO: 777406

SEQ ID NO: 777408 - protein, 291 aa, Homo sapiens
SFSFSSSVSPPYPCAELIKAPFWRGRGRRGAAAGSLCRALGLVGRPVLESALFVTAMSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEADRFPDVLPASATDPNCRTSHSSPRPPGSIQWGISSKRNQTNVFQPLHSGD

SEQ ID NO: 777409 - protein, 298 aa, Homo sapiens; identical to SEQ ID NO: 777398

SEQ ID NO: 777410 - protein, 88 aa, Homo sapiens
LEPLPTLTSGLGAQRGLWGGGQKPPGPQTPWAPSPLLKPQQESLCVSEAPSSKALVGFTQMTIAKGKHRSYLKFRDYPPLRMPIPFLL

SEQ ID NO: 777411 - protein, 53 aa, Homo sapiens
MEHSINPDILRPPLNKPGIGGGYQGLETGSGQRAPCTSWGCLNGKQKLELIVG

SEQ ID NO: 777412 - protein, 45 aa, Homo sapiens
MGSWEDPAMLFLMISERRLFSGSGQMMGEGQEAEFTTVSENTVYQ

SEQ ID NO: 777413 - protein, 1415 aa, Homo sapiens
MRCLRHSVQGSWVCRDWGLPEDFLEEVTATMGWEQWTLSRPRVRRDGGTQMPNLPGNTWLRPSPNPSPYFLPWSSSRSLSLAHLPGWIFNETDSEEVGAGRDPRILVIFLSTLCQGNLNWGQHLGPLTVTDWGRRSCSPLPLGVFWGPVVCWRKQVMRLVQRMWEAVTPGGHEGAVELQALQMTAASCFQEPGVQGHLCRGFLFSLPGVRGQCTTAEAGAQGASVVLIYLWKTSHSSSLQSEFFALSDLNLLRESCHSPLWAIVSLPVKFYYFSFLFLRCSLTLSPRLECNAVISAHCHLRLSSSSDFPASASRVAGIPGARHHAWLIFCIFSRDGILYVGQAGLELLTSGDLPTLASQSAGITGMSHCAWPLPVKFLNGELGARCGFQPGAWGAVLVSGAVQDTFALCHLHGHLEPAQVAKASWGPEPGDSPSGQLDSGGLWLTRSPAGALVQLRFPDSAPASTAVHVCVSCSRPRASVSRVCWGGMGQAVVLQHEEGAMRSSHDLPRLAIKCSSPHIRVGLGLPFTDHICEVPSWVLDIICLEKQLLVDPFYSERTKSHRGLGSSPTSATNWHVTLSILHCSEPRPWPLPGSLPGSLPPLTTSDGRCGGLLPGSQGWVRALEVLSLNQGGHSTGEWNCPASPCVALWVCEGGLAGGLGLALGAVLLPHFIDRETEALGGLTDIPTFKMSSGGLSSGAWEKGPSGFGKQPPAQGETCFFSSCGSIRRIVVSPVPSVNKDLYCEKIFSFFFGTQSHSVAQARVDWRDLRLNANLQGSIDSPASPSHVAGITAACQIFVFLVEPGFHHVGQAGLELLTSTDPPTLASQVLGLQARATAPSLEKMFLEPEETSVPTDPSGPRCAELPCWLGLSAAPGRCFLHLRMGEGWALGERGTWDLRLSSLRQAGLIGAISEKGRLKLSREEAFEGDPGRWRDGLGHQGHTRNMGGPCLSLDEGNGGRATTSVSVTQQHQAPRWAPRTHPLPYLCLHALFPPPRLPAEGAVPGGCLSLGKRGSDPVKMLDRQPPPPQKCVLSGEPFYSHLPAILTGGRFDGYRADPYLSTLLRTPRKLRRPSRLPDSCPGVAVCFFPGPTLRGSELRQNPFFIHFLQNKTTYRKVNKTYNAQPNTLLGSKRSATTIRKKFCQHPSALPSQCHFRPLCPGLCESCVLVFLKSLQHPIMQALQYFPVSVLYPLESYRCKFWQLASLARYYVCEIYSCCCAQYSLCMFIAKNFHCLAVIVVHRFISLSVKLVQCMQPRMPLNVAQHKFVNFLKTLYRFLFAIFFFSSSAIVSGSVFYAGPETVLPVWSMEAKRLDMPAVDGQLVCFYFGVTTHNAASNSFVHVSDARVFFANGAQIFLGFVLRSLTPGFQGMKIFLNIVLVYVPTSSKTEFPCLPILGRHFTFASLVGCIVMALICI

SEQ ID NO: 777414 - protein, 1382 aa, Homo sapiens
MGTVDPKQAKGAEGRWYPDAQVFQAIPGSGPAPIHPLTFCHGVPAGHSPWHTFQAGFLMKQTQGGGAGRDPRILVIFLSTLCQGNLNWGQHLGPLTVTDWGRRSCSPLPLGVFWGPVVCWRKQVMRLVQRMWEAVTPGGHEGAVELQALQMTAASCFQEPGVQGHLCRGFLFSLPGVRGQCTTAEAGAQGASVVLIYLWKTSHSSSLQSEFFALSDLNLLRESCHSPLWAIVSLPVKFYYFSFLFLRCSLTLSPRLECNAVISAHCHLRLSSSSDFPASASRVAGIPGARHHAWLIFCIFSRDGILYVGQAGLELLTSGDLPTLASQSAGITGMSHCAWPLPVKFLNGELGARCGFQPGAWGAVLVSGAVQDTFALCHLHGHLEPAQVAKASWGPEPGDRSLWPTGQLRLVVTRSPAGALVQLRFPDSAPASTAVHVCVSCSRPRASVSRVCWGGMGQAVVLQHEEGAMRSSHDLPRLAIKCSSPHIRVGLGLPFTDHICEVPSWVLDIICLEKQLLVDPFYSERTKSHRGLGSSPTSATNWHVTLSILHCSEPRPWPLPGSLPGSLPPLTTSDGRCGGLLPGSQGWVRALEVLSLNQGGHSTGEWNCPASPCVALWVCEGGLAGGLGLALGAVLLPHFIDRETEALGGLTDIPTFKMSSGGLSSGAWEKGPSGFGKQPPAQGETCFFSSCGSIRRIVVSPVPSVNKDLYCEKIFSFFFGTQSHSVAQARVDWRDLRLNANLQGSIDSPASPSHVAGITAACQIFVFLVEPGFHHVGQAGLELLTSTDPPTLASQVLGLQARATAPSLEKMFLEPEETSVPTDPSGPRCAELPLLVGAQRSPREVLPAPQDGRGWALGERGTWDLRLSSLRQAGLIGAISEKGRLKLSREEAFEGDPGRWRDGLGHQGHTRNMGGPCLSLDEGNGGRATTSVSVTQQHQAPRWAPRTHPLPYLCLHALFPPPRLPAEGAVPGGCLSLGKRGSDPVKMLDRQPPPPQKCVCVVNPFKPSSSHSPGGRFDGYRADPYLSTLLRTPRKLRRPSRLPDSCPGVAVCFFPGPTLRGSELRQNPFFIHFLQNKTTYRKVNKTYNAQPNTLLGSKRSATTIRKKFCQHPSALPSQCHFRPLCPGLCESCVLVFLKSLQHPIMQALQYFPVSVLYPLESYRCKFWQLASLARYYVCEIYSCCCAQYSLCMFIAKNFHCLAVIVVHRFISLSVKLVQCMQPRMPLNVAQHKFVNFLKTLYRFLFAIFFFSSSAIVSGSVFYAGPETVLPVWSMEAKRLDMPAVDGQLVCFYFGVTTHNAASNSFVHVSDARVFFANGAQIFLGFVLRSLTPGFQGMKIFLNIVLVYVPTSSKTEFPCLPILGRHFTFASLVGCIVMALICI

SEQ ID NO: 777415 - protein, 630 aa, Homo sapiens
GRSRRLPGQGRRAWRAPGRPRSWGRREAGARDEAAAAGGRGPGPCRCSQGRRAWIAPGKPAMPAAWTPFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 777416 - protein, 630 aa, Homo sapiens; identical to SEQ ID NO: 777415

SEQ ID NO: 777417 - protein, 1460 aa, Homo sapiens
MPCSYSCFIPCISEQLLGTSCMPGPIPDRGLLAWLSSQPSLGTAGYEVLTAQCPGQLGVQGLGAPGRFFGGSNSYDGMGTVDPKQAKGAEGRWYPDAQVFQAIPGSGPAPIHPLTFCHGVPAGHSPWHTFQAGFLMKQTQGGEGLAGTLESSVIFLSTLCQGNLNWGQHLGPLTVTDWGRRSCSPLPLGVFWGPVVCWRKQVMRLVQRMWEAVTPGGHEGAVELQALQMTAASCFQEPGVQGHLCRGFLFSLPGVRGQCTTAEAGAQGASVVLIYLWKTSHSSSLQSEFFALSDLNLLRESCHSPLWAIVSLPVKFYYFSFLFLRCSLTLSPRLECNAVISAHCHLRLSSSSDFPASASRVAGIPGARHHAWLIFCIFSRDGILYVGQAGLELLTSGDLPTLASQSAGITGMSHCAWPLPVKFLNGELGARCGFQPGAWGAVLVSGAVQDTFALCHLHGHLEPAQVAKASWGPEPGDRSLWPTGQLRLVVNPKPSWGLVQLRFPDSAPASTAVHVCVSCSRPRASVSRVCWGGMGQAVVLQHEEGAMRSSHDLPRLAIKCSSPHIRVGLGLPFTDHICEVPSWVLDIICLEKQLLVDPFYSERTKSHRGLGSSPTSATNWHVTLSILHCSEPRPWPLPGSLPGSLPPLTTSDGRCGGLLPGSQGWVRALEVLSLNQGGHSTGEWNCPASPCVALWVCEGGLAGGLGLALGAVLLPHFIDRETEALGGLTDIPTFKMSSGGLSSGAWEKGPSGFGKPPPAQGETCFFSSCGSIRRIVVSPVPSVNKDLYCEKIFSFFFGTQSHSVAQARVDWRDLRLNANLQGSIDSPASPSHVAGITAACQIFVFLVEPGFHHVGQAGLELLTSTDPPTLASQVLGLQARATAPSLEKMFLEPEETSVPTDPSGPRCAELLLLVGAQRSPREVLPAPQDGRGWALGERGTWDLRLSSLRQAGLIGAISEKGRLKLSREEAFEGDPGRWRDGLGHQGHTRNMGGPCLSLDEGNGGRATTSVSVTQQHQAPRWAPRTHPLPYLCLHALFPPPRLPAEGAVPGGCLSLGKRGSDPVKMLDRQPPPPQKCVCVVNPFKPSSSHSPGGRFDGYRADPYLSTLLRTPRKLRRPSRLPDSCPGVAVCFFPGPTLRGSELRQNPFFIHFLQNKTTYRKVNENINAQPNTLLGSKRSATTIRKKFCQHPSALPSQCHFRPLCPGLCESCVLVFLKSLQHPIMQALQYFPVSVLYPLESYRCKFWQLASLARYYVCEIYSCCCAQYSLCMFIAKNFHCLAVIVVHRFISLSVKLVQCMQPRMPLNVAQHKFVNFLKTLYRFLFAIFFFSSSAIVSGSVFYAGPETVLPVWSMEAKRLDMPAVDGQLVCFYFGVTTHNAASNSFVHVSDARVFFANGAQIFLGFVLRSLTPGFQGMKIFLNIVLVYVPTSSKTEFPCLPILGRHFTFASLVGCIVMALICI

SEQ ID NO: 777418 - protein, 1383 aa, Homo sapiens
MGTVDPKQAKGAEGRWYPDAQVFQAIPGSGPAPIHPLTFCHGVPAGHSPWHTFQAGFLMKQTQGGRGWQGPRILVIFLSTLCQGNLNWGQHLGPLTVTDWGRRSCSPLPLGVFWGPVVCWRKQVMRLVQRMWEAVTPGGHEGAVELQALQMTAASCFQEPGVQGHLCRGFLFSLPGVRGQCTTAEAGAQGASVVLIYLWKTSHSSSLQSEFFALSDLNLLRESCHSPLWAIVSLPVKFYYFSFLFLRCSLTLSPRLECNAVISAHCHLRLSSSSDFPASASRVAGIPGARHHAWLIFCIFSRDGILSCWPGWSRTPDLSDLPTLASQSAGITGMSHCAWPLPVKFLNGELGARCGFQPGAWGAVLVSGAVQDTFALCHLHGHLEPAQVAKASWGPEPGDRSLWPTGQLRLVVTRSPAGALVQLRFPDSAPASTAVHVCVSCSRPRASVSRVCWGGMGQAVVLQHEEGAMRSSHDLPRLAIKCSSPHIRVGLGLPFTDHICEVPSWVLDIICLEKQLLVDPFYSERTKSHRGLGSSPTSATNWHVTLSILHCSEPRPWPLPGSLPGSLPPLTTSDGRCGGLLPGSQGWVRALEVLSLNQGGHSTGEWNCPASPCVALWVCEGGLAGGLGLALGAVLLPHFIDRETEALGGLTDIPTFKMSSGGLSSGAWEKGPSGFGKQPPAQGETCFFSSCGSIRRIVVSPVPSVNKDLYCEKIFSFFFGTQSHSVAQARVDWRDLRLNANLQGSIDSPASPSHVAGITAACQIFVFLVEPGFHHVGQAGLELLTSTDPPTLASQVLGLQARATAPSLEKMFLEPEETSVPTDPSGPRCAELPLLVGAQRSPREVLPAPQDGRGWALGERGTWDLRLSSLRQAGLIGAISEKGRLKLSREEAFEGDPGRWRDGLGHQGHTRNMGGPCLSLDEGNGGRATTSVSVTQQHQAPRWAPRTHPLPYLCLHALFPPPRLPAEGAVPGGCLSLGKRGSDPVKMLDRQPPPPQKCVLSGEPFYSHLPAILTGGRFDGYRADPYLSTLLRTPRKLRRPSRLPDSCPGVAVCFFPGPTLRGSELRQNPFFIHFLQNKTTYRKVNENINAQPNTLLGSKRSATTIRKKFCQHPSALPSQCHFRPLCPGLCESCVLVFLKSLQHPIMQALQYFPVSVLYPLESYRCKFWQLASLARYYVCEIYSCCCAQYSLCMFIAKNFHCLAVIVVHRFISLSVKLVQCMQPRMPLNVAQHKFVNFLKTLYRFLFAIFFFSSSAIVSGSVFYAGPETVLPVWSMEAKRLDMPAVDGQLVCFYFGVTTHNAASNSFVHVSDARVFFANGAQIFLGFVLRSLTPGFQGMKIFLNIVLVYVPTSSKTEFPCLPILGRHFTFASLVGCIVMALICI

SEQ ID NO: 777419 - protein, 1309 aa, Homo sapiens
MGTVDPKQAKGAEGRWYPDAQVFQAIPGSGPAPIHPLTFCHGVPAGHSPWHTFQAGFLMKQTQGGRGWQGPRILVIFLSTLCQGNLNWGQHLGPLTVTDWGRRSCSPLPLGVFWGPVVCWRKQVMRLVQRMWEAVTPGGHEGAVELQALQMTAASCFQEPGVQGHLCRGFLFSLPGVRGQCTTAEAGAQGASVVLIYLWKTSHSSSLQSEFFALSDLNLLRESCHSPLWAIVSLPVKFYYFSFLFLRCSLTLSPRLECNAVISAHCHLRLSSSSDFPASASRVAGIPGARHHAWLIFCIFSETGFYHVGQAGLELLTSGDLPTLASQSAGITGMSHCAWPLPVKFLNGELGARCGFQPGAWGAVLVSGAVQDTFALCHLHGHLEPAQVAKASWGPEPGDRSLWPTGQLRLVVTRSPAGALVQLRFPDSAPASTAVHVCVSCSRPRASVSRVCWGGMGQAVVLQHEEGAMRSSHDLPRLAIKCSSPHIRVGLGLPFTDHICEVPSWVLDIICLEKQLLVDPFYSERTKSHRGLGSSPTSATNWHVTLSILHCSEPRPWPLPGSLPGSLPPLTTSDGRCGGLLPGSQGRVRALEVLSLNQGGHSTGEWNCPASPCVALWVCEGGLAGGLGLALGAVLLPHFIDRETEALGGLTDIPTFKMSSGGLSSGAWEKGPSGFGKQPPAQGETCFFSSCGSIRRIVVSPVPSVNKDLYCEKIFSFFFGTQSHSVAQARVDWRDLRLNANLQGSIDSPASPSHVAGITAACQIFVFLVEPGFHHVGQAGLELLTSTDPPTLASQVLGLQARATAPSLEKMFLEPEETSVPTDPSGPRCAELPLLVGAQRSPREVLPAPQDGRGWALGERGTWDLRLSSLRQAGLIGAIFIERQIEAQQEKKLLRVIQALEGWPRTPGSHQEHGRAVLVSRRGEWGKGHNLCFCDPAASSPSLGTSHTPPAFLCLHALFPPPRLPAEGAVPGGCLSLGKRGSDPVKMLDRQPPPPQKCVCVVNPFKPSSSHSPGGRFDGYRADPYLSTLLRTPRKLRRPSRLPDSCPGVAVCFFPGPTLRGSELRQNPFFIHFLQNKTTYRKVNENINAQPNTLLGSKRSATTIRKKFCQHPSALPSQCHFRPLCPGLCESCVLVFLKSLQHPIMQALQYFPVSVLYPLESYRCKFWQLASLARYYVCEIYSCCCAQYSLCMFIAKNFHCLAVIVVHRFISLSVKLVQCMQPRMPLNVAQHKFVNFLKTLYRFLFAIFFFSSSAIVSGSVFYAVTRDSSSGMVHGSQKIGHACCRWTVGLFLVWGNYTQCCQQQFCPCL

SEQ ID NO: 777420 - protein, 89 aa, Homo sapiens
LSLASVLGSCWHKFMALRAAETRGVDLPALSHAQLAPWLARALLGCFCQPHGSPTCSAPETYNSERTESQAWERGGKVRVKAARGGLTR

SEQ ID NO: 777421 - protein, 143 aa, Homo sapiens
SWQFIPTISQEPVICLIVLIISKYWESSMRQSVERDIEFYLTEFFHIFLIKNTLGNATLRLPFIFFSPHPLPWRTINAHSSSCHLSAKVSLVSAQAPLYPSSRTPLPIAHLHLDGSQWGRVGIYRGSEEVLNSLILHSTNMKK

SEQ ID NO: 777422 - protein, 111 aa, Homo sapiens
GNRGSGALANSGFRFKARWTGLQSPAALPLPVLPGPHSTGFISASWNWRGLAGPSVLTRSLSCVGSPGLSSRCQLSSHCHLVSCAVWPGPSKCPGGLSAVLGWVQPHGHHR

SEQ ID NO: 777423 - protein, 75 aa, Homo sapiens
EDRLAEEGGGFLAERDCGCGPAAYPSSSSPEPFLRNQPPQIRKLGFREIKGLGEAENAKGIDSVVDGESLKTVEQ

SEQ ID NO: 777424 - protein, 188 aa, Homo sapiens
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELY

SEQ ID NO: 777425 - protein, 51 aa, Homo sapiens
MYLVTVLRNLFSILAVSSDCPLHTPMYFFLSNLCWPDIGFTSAMVPKMIVD

SEQ ID NO: 777426 - protein, 101 aa, Homo sapiens
ICTIVTSLHGRNVIQVKGDKKIPFTAMQKTLTSHKEQVSSFRVRCCGQTPENRPHSWRRKRKANHGAQLFPPTDRTLEAGTTVTGGGPTSGTTLDMQDAGS

SEQ ID NO: 777427 - protein, 83 aa, Homo sapiens
SVRRSRGLLGGWLGVSSLYPDAHVGAPGFREPAKRPLSFLLWYSQTATGRAFRAWAGVGEGSFLNFLSQVYPYPRAPLREQIP

SEQ ID NO: 777428 - protein, 122 aa, Homo sapiens
NHSELHPYTVSWCWSFSMCSPPLMPSPSCLYPKRLPFLAGSWLVQPVGGIPCRKQDRGHRKGWVVLSHPSLLQSCVPVELHPSRPTSDPSLRPQLQLSPVSSFALPSLVCCLKPAHASLSSL

SEQ ID NO: 777429 - protein, 115 aa, Homo sapiens
HLKKMQLHGKGSQDPSTKVHIKALQTVTSFLLLCAIYFLSMIISVCNFGRLEKQPVFMFCQAIIFSYPSTHPFILILGNKKLKQIFLSVLRHVRYWVKDRSLRLHRFTRGALCVF

SEQ ID NO: 777430 - protein, 138 aa, Homo sapiens
FPREIHFHVHRYPIDTLPTSKEDLQLWCHKRWEEKEERLRSFYQGEKNFYFTGQSVIPPCKSELRVLVVKLLSILYWTLFSPAMCLLIYLYSLVKWYFIITIVIFVLQERIFGGLEIIELACYRLLHKQPHLNSKKNE

SEQ ID NO: 777431 - protein, 101 aa, Homo sapiens
AVTSVGEDGEESEPLHNAGEIVKWYSHVRTAWKSFRRLNMELPYDPAIPLLGVYPREMKTYVTQRLVGNVCSCITLNSQKLETSQPRSFPSQIPQEVYREV

SEQ ID NO: 777432 - protein, 148 aa, Homo sapiens
LIKCKLSHFNLQPSGNRSYPSSRNYDCGVNPFSCFLAVLFYNALEETETSLLHPGQEDKGGCMEIQTALLLQAIPTVQLATDFTWFWSNLNLEYARENFYQARWKTPRIGLSHGGIGTMVRVQWMEKASSLKMVMETSTAQGNTNQVP

SEQ ID NO: 777433 - protein, 192 aa, Homo sapiens
LIKCKLSHFNLQPSGNRSYPSSRNYDCGVNPFSCFLAVLFYNALEETETSLLHPGQEDKGGCMEIQTALLLQAIPTVQLATDFTWFWSNLNLEYARENFYQARWELLLGQDKSPHPLPSAWFWVMSPKRISPSVSQNPTSLVPSLLNPRGGKQLLPSTVRTARVCWEPIQLRVPVQQCCQVTNVETYSKNCM

SEQ ID NO: 777434 - protein, 134 aa, Homo sapiens
LIKCKLSHFNLQPSGNRSYPSSRNYDCGVNPFSCFLAVLFYNALEETETSLLHPGQEDKGGCMEIQTALLLQAIPTVQLATDFTWFWSNLNLEYARENFYQARWKTPRIGLSHGGIGNKKIMGKEIREGGKNTP

SEQ ID NO: 777435 - protein, 105 aa, Homo sapiens
SDTRVLSLCPGGAAGASAFLTPGSQPQSLPFAWMFAVATLLTSLLLVFSLSPVDLERYCQDDLSEILFSSVAWSEVLMSYCLCGLSLTGSPSFITFYNLLSTDHL

SEQ ID NO: 777436 - protein, 719 aa, Homo sapiens
GIWPPPPTPFPQAPGSCKSTICRTLGDRGWPEEMKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 777437 - protein, 625 aa, Homo sapiens
MCMCLVRYSSQAVTPEYTERIAEPNALRLKTQCYQVVAVSTQAQRYVSKAVYRHIFQAAKRVLDSISVYEHGLFQSISKSNFTYRRSSDRRVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 777438 - protein, 650 aa, Homo sapiens
GIWPPPPTPFPQAPGSCKSTICRTLGDRGWPEEMKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDIMHTERLECA

SEQ ID NO: 777439 - protein, 372 aa, Homo sapiens
GIWPPPPTPFPQAPGSCKSTICRTLGDRGWPEEMKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKVLTLLEITIYSSRFTLHQECLITDWKCLQTLL

SEQ ID NO: 777440 - protein, 719 aa, Homo sapiens; identical to SEQ ID NO: 777436

SEQ ID NO: 777441 - protein, 736 aa, Homo sapiens
GIWPPPPTPFPQAPGSCKSTICRTLGDRGWPEEMKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTGIKHKDLFIFSSLFLISETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 777442 - protein, 488 aa, Homo sapiens
GIWPPPPTPFPQAPGSCKSTICRTLGDRGWPEEMKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTGIKH

SEQ ID NO: 777443 - protein, 94 aa, Homo sapiens
TDKTQRTQSPMSGLGTVAMEDRQDTTHTITDVRIGDGCYRQRRDEEGAGLGAGSVTAEWSVDHCNDERASFGHSVDLEHPPKQTTHCQCVQKQR

SEQ ID NO: 777444 - protein, 103 aa, Homo sapiens
ISLPGSSLHSCIVLIVSLYHQVVTGTHPATSQLLLLPTPTWRGGVSTRELPTPDWRGGVSTRELPIPAWRGGVSMRELPIPAWRGGVSTRELLLRRKQLKHTQ

SEQ ID NO: 777445 - protein, 105 aa, Homo sapiens
NAVFAVAVWMASERSLSYYNFSQAGFVPVAHAAVSNTAHLPHSTAVSALPGLSKVVLKSLLRFRMTSCPGLPKSVLVLAQNVPSPGKHLNPRQARTIACPIWSLL

SEQ ID NO: 777446 - protein, 84 aa, Homo sapiens
IGSHDSKVKFHDKPSVSWGIEKPIVAQSKSKSPQTKEADSTRFSLQPSSSPWEATGAPPESKGRRIWSLMSKGRRSRSKHLAQK

SEQ ID NO: 777447 - protein, 1366 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 777448 - protein, 1226 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEGKE

SEQ ID NO: 777449 - protein, 1271 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTIRRIGNTLAQGVSHFWIRIPNM

SEQ ID NO: 777450 - protein, 657 aa, Homo sapiens
GLTVACGLTVACGLTVAIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 777451 - protein, 525 aa, Homo sapiens
SRGSSKHSNITGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 777452 - protein, 1425 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 777453 - protein, 762 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNGKY

SEQ ID NO: 777454 - protein, 1407 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDFTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 777455 - protein, 1072 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFFICDIYLPVTARPSTPNPTLLVWDSYPEMGKVVGGTDVP

SEQ ID NO: 777456 - protein, 559 aa, Homo sapiens
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLFFPQGSSKPAIYQCSFWWCKTQATF

SEQ ID NO: 777457 - protein, 713 aa, Homo sapiens
SWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 777458 - protein, 120 aa, Homo sapiens
PVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLDTESGI

SEQ ID NO: 777459 - protein, 74 aa, Homo sapiens
NLSKRCGGYTSPLSSLKMELDSILTEILETSHQFVLELLHQLVIRPECENRQTQLDAYSRQRERVSLKYGYDNS

SEQ ID NO: 777460 - protein, 281 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777461 - protein, 290 aa, Homo sapiens
MCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777462 - protein, 284 aa, Homo sapiens
MSFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777463 - protein, 413 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKVTGGPEDECKVTGGVGLQAPGWTCLGGSLVLGRWPLSPGQREGVAGTQAAGWVLPQLHPHAQSLVPAPTQGTCCPGRCPCGLRGATQPCCIQPGRLLCPWESQQSRQGSEGGGVRWGPPWWHRAHHSPADLQSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777464 - protein, 191 aa, Homo sapiens
MCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEGDFYAPSSTA

SEQ ID NO: 777465 - protein, 148 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKGDWPLPRKERPALGHQRLQLGHRQLLRRS

SEQ ID NO: 777466 - protein, 159 aa, Homo sapiens
MVTGPPRVSASTEEGTEAPRELAGAVLQRPLSRGSWLQGPGGMGPGRGLRAEAPAPAVDFQPSCVDWQVLGEWSGRPRLHRRLLDSRLHQQMWASCPKRPPTSLQRGETEARRGLTCLPRTVTRQGAGPGGARRDPHLPAQSPAERGGAGGCQARAGGH

SEQ ID NO: 777467 - protein, 319 aa, Homo sapiens
GRDGAAAAAGPAGGSAWRPSQAAASTQGPRARRALGGFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777468 - protein, 188 aa, Homo sapiens
MCACVCQCIRVCICVSVHVSACACVYLCVSIKGPPRPGAHRPPQRTLHCSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777469 - protein, 281 aa, Homo sapiens; identical to SEQ ID NO: 777460

SEQ ID NO: 777470 - protein, 422 aa, Homo sapiens
MCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKVTGGPEDECKVTGGVGLQAPGWTCLGGSLVLGRWPLSPGQREGVAGTQAAGWVLPQLHPHAQSLVPAPTQGTCCPGRCPCGLRGATQPCCIQPGRLLCPWESQQSRQGSEGGGVRWGPPWWHRAHHSPADLQSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777471 - protein, 205 aa, Homo sapiens
MCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSSGAVASNKAAVSFA

SEQ ID NO: 777472 - protein, 223 aa, Homo sapiens
GVGMGVVGKPVGASGHLKPSGLRGVRLQVGVILIVVLKSSLWVRWGPPWWHRAHHSPADLQSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKREPLCPRRAEPCPRVPATPRRMSDPL

SEQ ID NO: 777473 - protein, 81 aa, Homo sapiens
RYLASGSIEFQVKVLLTPHPHLVPPGSKEAHSLWFTNGLSWEIGNAPGGIQIASAHPTPNTWATESGQDEALAPRACSPAP

SEQ ID NO: 777474 - protein, 102 aa, Homo sapiens [sequence omitted]

SEQ ID NO: 777475 - protein, 107 aa, Homo sapiens
MATRWLPQLPGLSSPNNIQRQKGGSQKSVIFACLPPVIREEKSFPEAYWHSSVILPSVAKEACNMNLWHFHSLEWEEDKGGERFGAQPDSSVCHGIMPIDLSFPTSN

SEQ ID NO: 777476 - protein, 45 aa, Homo sapiens
GPNVHLKPGVHLGSDVQLKTGCPPGAEESTQGLVLNWGLMTTRGQ

SEQ ID NO: 777477 - protein, 159 aa, Homo sapiens
DIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 777478 - protein, 113 aa, Homo sapiens
GGIGEAVKVPIGCCWACSCSGMFSAVPAPGLFCPHIITAIAPLRCQLFGDPRLEAGQNLKGLWSLRSRLVTSFTENQVCILTKVSQVAPGGITVPALGFVGFVSLRKETVETQ

SEQ ID NO: 777479 - protein, 461 aa, Homo sapiens
FCISVHCRMASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 777480 - protein, 106 aa, Homo sapiens
MLFFHLGLIFVFFPQHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 777481 - protein, 78 aa, Homo sapiens
HRRARGPAVGTSPPGSELGRCVAPFADTCSVMAIPSCQFPAPTPTYGPHPRGTTNLVPSRGHSNPGLCPASTTSLMAP

SEQ ID NO: 777482 - protein, 381 aa, Homo sapiens
RFPEALPPPHRAALCRRSACLLPRTPPFIRHDKCQPSCSSPSRGRRSLPGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDIQFALSYNGFFWTQAFEYEVDPCSI

SEQ ID NO: 777483 - protein, 282 aa, Homo sapiens
MEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDIQFALSYNGFFWTQAFEYEVDPCSI

SEQ ID NO: 777484 - protein, 389 aa, Homo sapiens
RFPEALPPPHRAALCRRSACLLPRTPPFIRHDKCQPSCSSPSRGRRSLPGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAADLTMDSSGPKHLNMKLTRAPFEGIVPDLIQKRLLVLAKLCMQKSAVT

SEQ ID NO: 777485 - protein, 329 aa, Homo sapiens
RFPEALPPPHRAALCRRSACLLPRTPPFIRHDKCQPSCSSPSRGRRSLPGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKREVSYQCG

SEQ ID NO: 777486 - protein, 276 aa, Homo sapiens
AEGATTEGVVLGPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDIQFALSYNGFFWTQAFEYEVDPCSI

SEQ ID NO: 777487 - protein, 212 aa, Homo sapiens
MEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTATKDAGQISGLNVLRVINEPTAAALAYGLDKSEDKVIAVYDLGGGTFDISILEIQKGVFEVKSTNGDTFLGGEDFDQALLRHIVKEFKREVSYQCG

SEQ ID NO: 777488 - protein, 150 aa, Homo sapiens
RFPEALPPPHRAALCRRSACLLPRTPPFIRHDKCQPSCSSPSRGRRSLPGPTAARHQDSWNGLSHEAFRLVSRRDYASEAIKGAVVGIDLGTTNSCVAVMEGKQAKVLENAEGARTTPSVVAFTADGERLVGMPANETLGSIKCIVWVGD

SEQ ID NO: 777489 - protein, 178 aa, Homo sapiens
SNPDFIPAPNTMTCCQTSFCGYPSCSTSGTCGSSCCQPSCCETSCCQPSCCQTSFCGFPSFSTSGTCSSSCCQPSCCETSCCQPSCCQTSSCGTGCGIGGGIGYGQEGSSGAVSTRIRWCRPDCRVEGTCLPPCCVVSCTPPTCCQLHHAEASCCRPSYCGQSCCRPVCCCYSCEPTC

SEQ ID NO: 777490 - protein, 72 aa, Homo sapiens
CLEEGMSSPSLEIFEQKTETNCQGTCRVLFGDPVRVVWMSKIISEGTQKTHQLQGSIEQQFPRLVHPQNLLF

SEQ ID NO: 777491 - protein, 156 aa, Homo sapiens
MMVLDKEDGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 777492 - protein, 160 aa, Homo sapiens
AHPALLSVCPSAGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 777493 - protein, 160 aa, Homo sapiens; identical to SEQ ID NO: 777492

SEQ ID NO: 777494 - protein, 109 aa, Homo sapiens
HDPSSHVSPALTHPQLSHIPGPHMPPVLTRPQLSHIPGPHASLTLTPTQPHPSEHQACQHSSTPSHQPGMTHRARSDSRSSACPGVCVCVCARVHSLQARPFYHTCRFV

SEQ ID NO: 777495 - protein, 74 aa, Homo sapiens
TGSDEVGLPQEGLKALFPSPLDPNFLAPCMTGSSLGRWTRATPPTATCWANWAQPRAQVAGETPSGAGPIPRVR

SEQ ID NO: 777496 - protein, 173 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPS

SEQ ID NO: 777497 - protein, 173 aa, Homo sapiens; identical to SEQ ID NO: 777496

SEQ ID NO: 777498 - protein, 113 aa, Homo sapiens
QSKGHACIPCFKPPRAPHCLENRIQTHYHSSQGPPPAGPHPHGSPHTCTKIKSCDQIKDVYLPRLSPLSVPFPPLSKVQLKCLIFHDALLSHPPYSPTALYMSIRELLGFYLE

SEQ ID NO: 777499 - protein, 63 aa, Homo sapiens
MRYHYMPIQTAKALKILTMSSADKDCEAIETHILLMGMQNGIATLENSVEVLYTVKQTLTRRP

SEQ ID NO: 777500 - protein, 195 aa, Homo sapiens [sequence omitted]

SEQ ID NO: 777501 - protein, 46 aa, Homo sapiens
MEDLLRLTDYQRRLYWCHLRLSSDPMLSEFKSLDIIYEEIGPRGPT

SEQ ID NO: 777502 - protein, 107 aa, Homo sapiens
MVPEPRAEISCGSSCPGELYWSPPRWDCWSGGDPHLHVCGRSWTGHSLGHRDVLPLAALGHTLSRCVCVCVCGWVRICVCLCVCACGVGARVCTCVGKHCVCAYVCG

SEQ ID NO: 777503 - protein, 967 aa, Homo sapiens
MEPQVTLNVTFKNEIQSFLVSDPENTTWADIEAMVKVSFDLNTIQIKYLDEENEEVSINSQGEYEEALKLMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 777504 - protein, 963 aa, Homo sapiens
MEPQVTLNVTFKNEIQSFLVSDPENTTWADIEAMVKVSFDLNTIQIKYLDEENEEVKYIMALIDSVMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 777505 - protein, 967 aa, Homo sapiens; identical to SEQ ID NO: 777503

SEQ ID NO: 777506 - protein, 963 aa, Homo sapiens; identical to SEQ ID NO: 777504

SEQ ID NO: 777507 - protein, 897 aa, Homo sapiens
MAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 777508 - protein, 997 aa, Homo sapiens
PTGIAAEPVADGPCIGLRQAPPGGGKLPHSMEPQVTLNVTFKNEIQSFLVSDPENTTWADIEAMVKVSFDLNTIQIKYLDEENEEVSINSQGEYEEALKLMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 777509 - protein, 478 aa, Homo sapiens
LRGFRVIRTSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 777510 - protein, 967 aa, Homo sapiens; identical to SEQ ID NO: 777503

SEQ ID NO: 777511 - protein, 839 aa, Homo sapiens
MEPQVTLNVTFKNEIQSFLVSDPENTTWADIEAMVKVSFDLNTIQIKYLDEENEEVSINSQGEYEEALKLMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRYHSQPLQLGCSSEVK

SEQ ID NO: 777512 - protein, 608 aa, Homo sapiens
MEPQVTLNVTFKNEIQSFLVSDPENTTWADIEAMVKVSFDLNTIQIKYLDEENEEVSINSQGEYEEALKLMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVGKNVTHFILFVLLIGTKVPQPRHW

SEQ ID NO: 777513 - protein, 129 aa, Homo sapiens
MELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 777514 - protein, 188 aa, Homo sapiens
MEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 777515 - protein, 129 aa, Homo sapiens; identical to SEQ ID NO: 777513

SEQ ID NO: 777516 - protein, 72 aa, Homo sapiens
RQKSLWADVHGKLRSHIDALREQNMELREKLRALQLQRWKARKKSAASPHAGQESHTLVPKAHLCFCTVCVM

SEQ ID NO: 777517 - protein, 188 aa, Homo sapiens; identical to SEQ ID NO: 777514

SEQ ID NO: 777518 - protein, 167 aa, Homo sapiens
MEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKLLFRTFSQPVCLFLSQLCVTLILRKQIS

SEQ ID NO: 777519 - protein, 139 aa, Homo sapiens
PHQRLHFVDKPYECKECGKAFRVRQQLTFHHRIHTGEKPYECKECGMAFRQTAHLTRHQRLHSGEKLYECKECGEAFICGADLRVHQKMHIGEKPYECKECGKAFRVRGQLTLHQRIHTGEKPYVCKECGKAFRQYAHL

SEQ ID NO: 777520 - protein, 113 aa, Homo sapiens
TMFTYSLRGCDSAGCTELGCLSFSIASRATGNLLRLTLPVFNPPIILSAPLSAPLWALVLKHSFPNTVLPIGLYSAFSACSVPDAMLDTEVKDMSPLFPRSPRSSFFLRNKVT

SEQ ID NO: 777521 - protein, 113 aa, Homo sapiens
MEQNREPKNKAKYSQLIFNKANKNMKWRKDTLFNKWCWDNWQATCRRMKLDPHLSPYTKINSRWIKDLNLTPIKILEDNIRKTLLDIGLGKDFMTKNPKANATKTRINRWDLI

SEQ ID NO: 777522 - protein, 168 aa, Homo sapiens
IIHDEPTYARSSKNAIKVPIVINPNAYDNLAIYKSFLGTSGELSVKEKTTSVISHTYEEIETESKVPDNTTSKTTDCLQTKGFSNSTEHKRGSVAQKVQEFNNCLNRGQSSPQRSYSSSHSSPAKIQRATQEPVAKIEGTQESQMVGSSQHQRESKHSAFSDCGFNPT

SEQ ID NO: 777523 - protein, 111 aa, Homo sapiens
MVNTTEGCRSSLKRFPTDSDGFLPGRCYGRQRFGSDGPVRSCLPGIFHPEVLFLTQHNLEGPTKSYSLGLICNAGEPMNYANRGPRRRCWLVHLHSVLGLGGRMAGQAEET

SEQ ID NO: 777524 - protein, 170 aa, Homo sapiens
RPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNFHS

SEQ ID NO: 777525 - protein, 133 aa, Homo sapiens
ACDVRLQTMYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGL

SEQ ID NO: 777526 - protein, 297 aa, Homo sapiens
ACDVRLQTMYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 777527 - protein, 774 aa, Homo sapiens
FPILCLLRSLSKMGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 777528 - protein, 655 aa, Homo sapiens
GRNVSRAVSKVSQSRRKAGVPTANIEESQAVEAAMANVPWAEVCEKFQAALALSRVELHKNPEKEPYKSKYSARALLEEVKALLGPAPEDEDERPEAEDSPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPDSHIVKKINNLNKSALKYYQLFLDSLRDPNKVFPEHIGEDVLRPAMLAKFRVARLYGKIITADPKKELENLATSLEHYKFIVDYCEKHPEAAQEIEVELELSKEMVSLLPTKMERFRTKMALT

SEQ ID NO: 777529 - protein, 399 aa, Homo sapiens [sequence omitted]

SEQ ID NO: 777530 - protein, 655 aa, Homo sapiens; identical to SEQ ID NO: 777528

SEQ ID NO: 777531 - protein, 564 aa, Homo sapiens
GRNVSRAVSKVSQSRRKAGVPTANIEESQAVEAAMANVPWAEVCEKFQAALALSRVELHKNPEKEPYKSKYSARALLEEVKALLGPAPEDEDERPEAEDSPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPELLETFKFRTKPENFSYRVSTMSLRQHELLTD

SEQ ID NO: 777532 - protein, 334 aa, Homo sapiens
GRNVSRAVSKVSQSRRKAGVPTANIEESQAVEAAMANVPWAEVCEKFQAALALSRVELHKNPEKEPYKSKYSARALLEEVKALLGPAPEDEDERPEAEDSPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDSKFTFACFT

SEQ ID NO: 777533 - protein, 37 aa, Homo sapiens
MNDWTDEDEISKCRQPRKMSRHQRKDDKSHLRNAYVE

SEQ ID NO: 777534 - protein, 73 aa, Homo sapiens
QSFITIEAITIKNHTSTFRIGLHCCDKECAHIKTMHRLKRVAKLLLRNTLIHVPSNGCEGAPQCTLYTEYYNS

SEQ ID NO: 777535 - protein, 185 aa, Homo sapiens
MVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 777536 - protein, 325 aa, Homo sapiens
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 777537 - protein, 349 aa, Homo sapiens
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVISSSTKNSPSTRVMRNLTQAAREVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 777538 - protein, 254 aa, Homo sapiens
SINPKVHSSKPHLRQARRALWTMRSSGLDRVLPQRVQPLLPLLLLGLRVLLMLVEPAAHGACLLRPQVQGLVVPALVEFPEVFFLSLVNNSENTGNGFADDSDLRELGGRTACHFGDAQLGQLHLQVVQLFQQLLLLPAKISSLDLGHCCTGRRRRRAARSEGKSVDSNINLPNDTASTCPEKNENICLQQMCTKIFIADYYFLRQGLTLSLRLECSGAVLAHCSLRGLGSCDPPIFTSLSRWDYRCVPPCLAN

SEQ ID NO: 777539 - protein, 146 aa, Homo sapiens
EEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 777540 - protein, 101 aa, Homo sapiens
SFLYRNSSVRTPQPTQTAEQIPGTCFCAISPLKLKSKHIRAWQGCMGTLANRQNTLAPQALLVFFPLDQQIFLTAYTCSSPTPNNMQKRKAPQVFLDQEVK

SEQ ID NO: 777541 - protein, 318 aa, Homo sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 777542 - protein, 318 aa, Homo sapiens; identical to SEQ ID NO: 777541

SEQ ID NO: 777543 - protein, 315 aa, Homo sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSDGVSPCWPGWSRSPGLVIRLPWPPKVLGLQA

SEQ ID NO: 777544 - protein, 289 aa, Homo sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSKLWEP

SEQ ID NO: 777545 - protein, 115 aa, Homo sapiens
PKQNGDLSVCKVLILPTTPHCLKMSLGLTPQQGSSRYSKKSPKSLYRTKGGSYHSPLSGAGFQDSTVTGNCVALTLLQPCSLPLQSSFVFCVYQMILLSKEAFCWENDVLKMVFQ

SEQ ID NO: 777546 - protein, 42 aa, Homo sapiens
LTQSFLSYDHITLQTLHFPNSINFNPPLIVDPNSIHQINFLF

SEQ ID NO: 777547 - protein, 40 aa, Homo sapiens
MGPEDRRGRSAKSPGEAVVSRRGQQRSVGGPLQRAAGFRL

SEQ ID NO: 777548 - protein, 113 aa, Homo sapiens
TGGHENTENHRRTGGHENTEIHRHTQVGMKTRKFTDTQVGVKTRKFTDAQVGVKTRKFTDAQVGVKTRKFTDAQVGVKTWKFTDTQVGVKTRKFTDAQVGVKTRKLTETHRLA

SEQ ID NO: 777549 - protein, 78 aa, Homo sapiens
LEDPEKTTEGRKRRKEVSQAEGGKTTEGEKTTEGEDPAAPISVNAHHPLTHLSESEVWTAASIPYLQSQQWGNRAVDR

SEQ ID NO: 777550 - protein, 108 aa, Homo sapiens
ECSWSPGKLAFKNQTAMDTALPKIWFTFFTGLTIGANKYNHVKPVRLYHFMARVLSHKHLFGKAHLPLSLDSPAILIKDLPGEQAAILSSSQQELIIKESCSVAQAGV

SEQ ID NO: 777551 - protein, 71 aa, Homo sapiens
PESGQSPAWRCGRESPTSGQLGPAAVAGRPNLGVEEPTDRRPFGAWRCHRRAGAHPGEATVRPDLGLGSLA

SEQ ID NO: 777552 - protein, 68 aa, Homo sapiens
AASTQVWKMNPAGTCSFYPSVNIEPSRDLQLLLKCGHCTKQGPAASTQVWTLNPAATYKCGHSNCFMT

SEQ ID NO: 777553 - protein, 85 aa, Homo sapiens
GSRGGSRRRRRRRLGIRHGGGSEPGVDLPAPVLDLRDHQGRPSLLHQRGGQEHHLAAPRHRRGGGHRTPAAEHRFAYWLGRSIYF

SEQ ID NO: 777554 - protein, 958 aa, Homo sapiens
ASVTLEDPVNFYTDEVGFDKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777555 - protein, 1116 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777556 - protein, 1125 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMSILTSVETIQS

SEQ ID NO: 777557 - protein, 312 aa, Homo sapiens
PVPGYSEELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777558 - protein, 796 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVK

SEQ ID NO: 777559 - protein, 1096 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAAILTSVETIQS

SEQ ID NO: 777560 - protein, 589 aa, Homo sapiens [sequence omitted]

SEQ ID NO: 777561 - protein, 793 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGKLALHFIL

SEQ ID NO: 777562 - protein, 480 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSIL

SEQ ID NO: 777563 - protein, 1116 aa, Homo sapiens; identical to SEQ ID NO: 777555

SEQ ID NO: 777564 - protein, 1060 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777565 - protein, 1174 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777566 - protein, 242 aa, Homo sapiens
MMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 777567 - protein, 650 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTWGREKVATATGAAEAVASDTHLPRTGSSSPSLLCV

SEQ ID NO: 777568 - protein, 1116 aa, Homo sapiens; identical to SEQ ID NO: 777555

SEQ ID NO: 777569 - protein, 650 aa, Homo sapiens; identical to SEQ ID NO: 777567

SEQ ID NO: 777570 - protein, 85 aa, Homo sapiens; identical to SEQ ID NO: 777553

SEQ ID NO: 777571 - protein, 70 aa, Homo sapiens
MKLGADVSEYDGAPSLWSQSKMELRADGTQSQMELGVTGALSKVELRTDGAQSKMELGVIGAPSKMELGA

SEQ ID NO: 777572 - protein, 70 aa, Homo sapiens
DERWEGLHDANHNKQGASQIRKEARDQRLVSSPVTAGQAPQRSENPGTTRKRWSPHTLRRKWFRARAPRP

SEQ ID NO: 777573 - protein, 111 aa, Homo sapiens
DFSQLNKNPPPIAMYCCALRSCSVPTGPATTFCSFDKSCRCGVCLPSTCPHEISLLQPICCDTCPPPCCKPDTYVPTCWLLNNCHPTPGLSGINLTTYVQPGCESPCEPRC

SEQ ID NO: 777574 - protein, 133 aa, Homo sapiens
RRWDHLVAGNKLRAPIDSTLWGPQAPGCRAIPVPGLLGTGSHGRSVPTGPATTFCSFDKSCRCGVCLPSTCPHEISLLQPICCDTCPPPCCKPDTYVPTCWLLNNCHPTPGLSGINLTTYVQPGCESPCEPRC

SEQ ID NO: 777575 - protein, 170 aa, Homo sapiens
MPQNSPWASHAAWHIYSLGALGSEGLGSSFIYKEIEAKPRQVTPAGLNQPSASMGSSVPPGCGRESLNQQPIVVRNRGRAGVQMAYQRGASSHGGPGGLLSEEHPKLSRTCTQSGRGSAEAHRHPQPHAHAWPGENLGSPCSCDVFSASSPWKVPMLKCGCTQCCLWMEL

SEQ ID NO: 777576 - protein, 135 aa, Homo sapiens
MEEDSQHKRPLEGPQRPSHHTTDMRRHTAAPNPPRTSAPITQYRHTTHAHHDATWAPATTNFDDRHPQKRATSHSNMARTRVHKPRPGVRPHLTERHKPEHARERHLTAVTPPPTIITPTKTRSRDDYYAHNEDL

SEQ ID NO: 777577 - protein, 123 aa, Homo sapiens
MPPRGLQISTPGSPLPPQLWGLHPAEPQGRAHPLSQCGLDTRHRVEGDYFGALRFNDCPAGFQTCMGPVAPLFWPVCLFGLVVFSQCLYPHCILEVTNLFLILQAHRWKGLALSQMRLWTVDF

SEQ ID NO: 777578 - protein, 33 aa, Homo sapiens
GTSQFSSESLIMEWIKHKTKNSTAIDGSVTAHP

SEQ ID NO: 777579 - protein, 70 aa, Homo sapiens
MFHAGGSSFLLMGQISGSLLGQRGKEEMGYFPMGKPRQDPSHSCICTHAAQTWGSASPAQRGWHLGRSPS

SEQ ID NO: 777580 - protein, 95 aa, Homo sapiens
FTHTQRTHIRTTHTQNAHTSVRRTHRMHVRTYNAHKEYTHPYNTQAHNTHVHAHGATYRYTKTRVHTHAESPGQRWRHGGLPPHRLQECLQLWIT

SEQ ID NO: 777581 - protein, 257 aa, Homo sapiens
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 777582 - protein, 257 aa, Homo sapiens; identical to SEQ ID NO: 777581

SEQ ID NO: 777583 - protein, 257 aa, Homo sapiens; identical to SEQ ID NO: 777581

SEQ ID NO: 777584 - protein, 257 aa, Homo sapiens; identical to SEQ ID NO: 777581

SEQ ID NO: 777585 - protein, 199 aa, Homo sapiens
MGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 777586 - protein, 199 aa, Homo sapiens; identical to SEQ ID NO: 777585

SEQ ID NO: 777587 - protein, 171 aa, Homo sapiens
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVVCWGTVGWRCLAGSEL

SEQ ID NO: 777588 - protein, 257 aa, Homo sapiens; identical to SEQ ID NO: 777581

SEQ ID NO: 777589 - protein, 77 aa, Homo sapiens
GRVADSGAQAVASQTGGESSIVWDKYGPEGSMADEKAGLRNWVTLDPELENDTVVSGRKKKKRLTRKLRVPSPRLLL

SEQ ID NO: 777590 - protein, 616 aa, Homo sapiens
ARRRMGAAPSPTQASSRGGGPGPPAPTRAVSSSSRARGGALSALGPSPARPLTTSPAPAPPPRSRPARQQPDPQCWEKRGGAGGDTKGGAAGPGPGRLRGMDAEYPAFEPPLCSELKHLCRRLREAYRELKEDLTPFKDDRYYRLAPMRLYTLSKRHFVLVFVVFFICFGLTIFVGIRGPKVIQTSAANFSLNNSKKLKPIQILSNPLSTYNQQLWLTCVVELDQSKETSIKTSFPMTVKVDGVAQDGTTMYIHNKVHNRTRTLTCAGKCAEIIVAHLGYLNYTQYTVIVGFEHLKLPIKGMNFTWKTYNPAFSRLEIWFRFFFVVLTFIVTCLFAHSLRKFSMRDWGIEQKWMSVLLPLLLLYNDPFFPLSFLVNSWLPGMLDDLFQSMFLCALLLFWLCVYHGIRVQGERKCLTFYLPKFFIVGLLWLASVTLGIWQTVNELHDPMYQYRVDTGNFQGMKVFFMVVAAVYILYLLFLIVRACSELRHMPYVDLRLKFLTALTFVVLVISIAILYLRFGAQVLQDNFVAELSTHYQNSAEFLSFYGLLNFYLYTLAFVYSPSKNALYESQLKDNPAFSMLNDSDDDVIYGSDYEEMPLQNGQAIRAKYKEESDSD

SEQ ID NO: 777591 - protein, 616 aa, Homo sapiens; identical to SEQ ID NO: 777590

SEQ ID NO: 777592 - protein, 243 aa, Homo sapiens
ARRRMGAAPSPTQASSRGGGPGPPAPTRAVSSSSRARGGALSALGPSPARPLTTSPAPAPPPRSRPARQQPDPQCWEKRGGAGGDTKGGAAGPGPGRLRGMDAEYPAFEPPLCSELKHLCRRLREAYRELKEDLTPFKDDRYYRLAPMRLYTLSKRHFVLVFVVFFICFGLTIFVGIRGKVRFLLIESFAMRGGPGVLLSVSPAVPLSSTAKGPSVEGEVSTGWMGSQPCASSCSVSCGGGVQ

SEQ ID NO: 777593 - protein, 150 aa, Homo sapiens
TFLEIHPEPPPSDTMVNSCCGSVCSDQGCGLENCCRPSCCQTTCCRTTCCRPSCCVSSCCRPQCCQSVCCQPTCCSPSCCQTTCCRTTCCRPSCCVSSCFRPQCCQSVCCQPTCCRPSCGQTTCCRTTCYRPSCCVSTCCRPTCSSGSCC

SEQ ID NO: 777594 - protein, 115 aa, Homo sapiens
STATYILTQAGMQQRDLGSPQPPPPRFKRYFCLSLLSSWDYRHVPPRPANFRIFSRDRFHHVGQAGLELLVSPQPTLLWFLPCYTTETVPVKVNRDTHAAKSRVTYLSDLHPITI

SEQ ID NO: 777595 - protein, 132 aa, Homo sapiens
MDTCRPIFSPEVLVVGKCKIQRNFSPSMAHCQIKPFSARSGFGSSNRSFLHASEVPKALILGVTSLVRVSATGQDPGAMGHAVPYFIRGVQLSPAHAFSLRKAAGTDIRGWMFLEVHLGEPLGSLACCFLES

SEQ ID NO: 777596 - protein, 135 aa, Homo sapiens
QGASDRWGQSPAGKGGLPPCSAARISSSPGGLPPVLSRVHPSVPRSVSQRSLMEALGSGHYVGGSIRSMAAAALSGLAVRLSRPQGTRGSYGAFCKTLTRTLLTFFDLAWRLRKNFFYFYILASVILNVHLQVYI

SEQ ID NO: 777597 - protein, 135 aa, Homo sapiens; identical to SEQ ID NO: 777596

SEQ ID NO: 777598 - protein, 52 aa, Homo sapiens
SSSLSFCRTGAQAMSGAREKRVSKRLSPCPGPDSHQAGDRRSTARWGKEGRS

SEQ ID NO: 777599 - protein, 119 aa, Homo sapiens
MVRNIFMKNFETNKPSTSIKIILRCLQHYKSSKYRQSPTYRHTGHLPNVNDSHTAGLACAGTLLLPVSRLSTLNPTPLPRRGKEGRTDARRVMSGAPSQLPRGFCCSSYFPHSHLWFLP

SEQ ID NO: 777600 - protein, 105 aa, Homo sapiens
AFIRILLCASKGMHAISHLISKTGLQDKFSFHAHLKDEENKADRYSLKLLELGQARWLTLVIPALWETEAGGSPRSGVRDQPGQHGETPSLLKIQKLARHDGACL

SEQ ID NO: 777601 - protein, 136 aa, Homo sapiens
FFFKDGVSLCCPGWSAMAQSWLTATSTSWVQADSPASASRVAGITGACHHAQMIFVFLVEMGFHHVRQAGLKLLTSGDQPTLASQSTGITGVSHCAQPHLALSLLPHTTESSPTLHPQLMTLLPISPRKENHREVS

SEQ ID NO: 777602 - protein, 49 aa, Homo sapiens
MFLGFGGTEVTCSQGGGRTMISRSESGVSQPDLSVKGSGGDEQTGFHTF

SEQ ID NO: 777603 - protein, 88 aa, Homo sapiens
QTCVMHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 777604 - protein, 134 aa, Homo sapiens
SHCPASHLTPDGVSSLLGVSRVGHPNPLWQVKNPEAQRGEVTSPVSHTSWRAGGRSTPDLLTLRLKQESIMLIIQNLPGLFLLLQTQRAKLTLPQLCSRFHSLTFNLMIVKLGSCGRHHSATCRSHCPCLGHLS

SEQ ID NO: 777605 - protein, 126 aa, Homo sapiens
FLCRWAAGRLQAVRVFDFLTHGKEAVMDSRWPCVLGSGSQVLGQQGRALQMERGSETHGYDTSLHPLPLPSSHVRAFSTPQGSLRPSLGPPPRPCIPAVLHRGLIRTLLLLQALPWLCPFPWLTRP

SEQ ID NO: 777606 - protein, 52 aa, Homo sapiens
MVAAHDSLAADYCVLPSVTFQCNVTAALRRSICFPGAPSRLPHPILSVGASG

SEQ ID NO: 777607 - protein, 90 aa, Homo sapiens
MRLSVCLLLLTLALCCYRANAVVCQALGSEITGFLLAGKPVFKFQLAKFKAPLEAVAAKMEVKKCVDTMAYEKRVLITKTLGKIAEKCDR

SEQ ID NO: 777608 - protein, 70 aa, Homo sapiens
RNGALLDKNFFNANSHFPVKGERIRRRMDLDRVKAEATEDITSGVLCLLFLRLPPNSCIFPSAVLGSTRT

SEQ ID NO: 777609 - protein, 148 aa, Homo sapiens
GPGTQTPSILCSLHPCAVAFVHLVHHTHIPSSQRESKEGGNEREGIPFSLSFYGTIWKFHYRCHTWLRGSLGRCGLQLNHGSCWQTQPDRPYRQGRTWPLQPVLSPHFLTCSCQRVSSLLFLGCPELNSLDSSLACSFSHLRCPLAKR

SEQ ID NO: 777610 - protein, 630 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHVLQCTAKSSLKESSRSFQCSVCNSSFSSASSFEQHQETCRGDAKFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 777611 - protein, 180 aa, Homo sapiens [sequence omitted]

SEQ ID NO: 777612 - protein, 111 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQDKNLGPAEWRG

SEQ ID NO: 777613 - protein, 630 aa, Homo sapiens; identical to SEQ ID NO: 777610

SEQ ID NO: 777614 - protein, 110 aa, Homo sapiens
HTASLGKHFLFCMFLISFSTVLLSSAQDISGLKDTRNNLPLAPPYTSLATVLFWTICLPHSYTVASVLGFHTLTLAAFCLLLLPLYSNYQSTMNSKCHIHSSLQFQTPAL

SEQ ID NO: 777615 - protein, 151 aa, Homo sapiens
MERPEPELIRQSWRAVSRSPLEHGTVLFARLFALEPDLLPLFQYNCRQFSSPEDCLSSPEFLDHIRKVMLVIDAAVTNVEDLSSLEEYLASLGRKHRAVGVKLSSFSTVGESLLYMLEKCLGPAFTPATRAAWSQLYGAVVQAMSRGWDGE

SEQ ID NO: 777616 - protein, 118 aa, Homo sapiens
LSPPERERRIKAHLGKGAPLCDWNVWTALETYLQLQEAFGWEPFTQLFAEYQTLSHLPKDNTGRMNLWVKKFSEKVKKNLVPFFEAWGWPIQKEVADSLASLPEWQENPMQVYLRARK

SEQ ID NO: 777617 - protein, 106 aa, Homo sapiens
TDSTLPLWSGSSHRQNISAWAWLCSSKNFIYKNRTFMKTGHGLGFVLSGHSVPTPGLHRRTLMSATIGTCTSYCCDTHRDTSCLVSEEVNKKVRLVHLNFSLPPQF

SEQ ID NO: 777618 - protein, 130 aa, Homo sapiens
KKTNNPIKKWAKDMNRHFSKEDIYAAKRHMKKCSSSLAIREMQIKTTMRYHLTPVRMAIIKKSGNNRCWRGCGEIGTLLHCWWDCKLVQPLWKSVWRFLRDLELEIPFDPAIPLLGIYPKDYKSCCYKGI

SEQ ID NO: 777619 - protein, 39 aa, Homo sapiens
MSDPGAENSEVPMNSEVPMNSEVPMNSEVPMNSEVPMNS

SEQ ID NO: 777620 - protein, 210 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 777621 - protein, 180 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 777622 - protein, 33 aa, Homo sapiens
FGGPSAGRKSPSSLQHSKLRQEGADLRVSRLHG

SEQ ID NO: 777623 - protein, 711 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQKIHTGERQYACSECGKAFTQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 777624 - protein, 693 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQNQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 777625 - protein, 112 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQGLAQLAPPFHLHHL

SEQ ID NO: 777626 - protein, 107 aa, Homo sapiens
MVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVV

SEQ ID NO: 777627 - protein, 51 aa, Homo sapiens
MPADVNLSQKPQVLGPEKQDGSCEVNRGSPGDSSPEREGRHRMQQVWAPCS

SEQ ID NO: 777628 - protein, 116 aa, Homo sapiens
TPSVGDFLRRTHSPHHVVLSSQHGSLLRKDTEQASRGKSRGAESGDLGASSQEPVLVQLHRTRLFSPVSGYDNTCELSATGILLGTQRPGFLLGRSMYPNSRLPEGKQVFSGKHTC

SEQ ID NO: 777629 - protein, 532 aa, Homo sapiens
MNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 777630 - protein, 559 aa, Homo sapiens
MVGKDTSTVEEPCPRGEDPTGDSNPTTMNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 777631 - protein, 145 aa, Homo sapiens
MPTSTSWQSTWSPSHISISLCLALPLSPAMEASSIKLTVSEFTQHVFNAKNMMAACEPRHGLYFTLAAVFTGQISMKDVNDKMLNMQNKTQQLLCGMDLQQRQEQSDIPFYGLKWSFTGIVNMVFQKLFKYIADQRKGSSGEKRP

SEQ ID NO: 777632 - protein, 39 aa, Homo sapiens
QRGFRKHVAKMKEPVPEWRGKTQEGTGHGEAPKGGVWSG

SEQ ID NO: 777633 - protein, 487 aa, Homo sapiens
GVALQRRQIARRRRRLHAAGGLLAPVRPARQEGVGGCGRAGSQARGPRPDAGRGAEPPVRPPGLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 777634 - protein, 450 aa, Homo sapiens
GAWLFRGGKLQGDAAAFMLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 777635 - protein, 379 aa, Homo sapiens
GAWLFRGGKLQGDAAAFMLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAPRSCRPWRPSSCEWLCWTSRSTWKRCFWKRRWGCNRGPQP

SEQ ID NO: 777636 - protein, 422 aa, Homo sapiens
GAWLFRGGKLQGDAAAFMLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLLEEEVGVQQRSAALRTRG

SEQ ID NO: 777637 - protein, 530 aa, Homo sapiens
GAWLFRGGKLQGDAAAFMLPAGCSRRLVAELQGALDACAQRQLQLEQSLRVCRRLLHAWYADPGPTGQTSLGPSESRPERPGLGDRAQPPTSELWVVSATLLTLQALSWGPAAGPGGPSGLFGLGPASWPCDGCPCLCREPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 777638 - protein, 417 aa, Homo sapiens
GAWLFRGGKLQGDAAAFMLPAGCSRREPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 777639 - protein, 225 aa, Homo sapiens
SSVPQARVLGTDLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 777640 - protein, 103 aa, Homo sapiens
GVALQRRQIARRRRRLHAAGGLLAPVRPARQEGVGGCGRAGSQARGPRPDAGRGAEPPVRPPGWWPSCRAPWTPAHSDNCNWSRACAFAVGCCMPGNQLGPGL

SEQ ID NO: 777641 - protein, 238 aa, Homo sapiens
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 777642 - protein, 86 aa, Homo sapiens
ESRSPRKYCQYRIKLGSDSAERKHLRNNKIPRRKINNKKDMNDTILLDETNICRTLSLARANTPASQAHTQYFPGWTNGRPQSKPP

SEQ ID NO: 777643 - protein, 184 aa, Homo sapiens
SPSPSPPFYSLAPGILDARAGGAGASSEPPGPSEARAPPSQLPNPPASEMRPRMLPVFFGESIKVNPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 777644 - protein, 184 aa, Homo sapiens; identical to SEQ ID NO: 777643

SEQ ID NO: 777645 - protein, 102 aa, Homo sapiens [sequence omitted]

SEQ ID NO: 777646 - protein, 137 aa, Homo sapiens
KKINHLKRDPKLKGPNRIVSHETWRAFERKKPRPGPALGLHTLGGAEARSGHPAKLSLTGRGHVACRPPGKWIIASRQRPRCDHADLDVQPPTCAQSGPLSSRGPRGPAPIPPAAVPSQHAATPAPGEGFPSVQTPV

SEQ ID NO: 777647 - protein, 116 aa, Homo sapiens
AAAWTRVRRAGGDDGPAMARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQLHR

SEQ ID NO: 777648 - protein, 116 aa, Homo sapiens; identical to SEQ ID NO: 777647

SEQ ID NO: 777649 - protein, 141 aa, Homo sapiens
MDVRRVLVKAEMEKFLQNKELFSSLKKGKICCCCRAKFPLFSWPPSCLFCKRGLCKGHSGRAWRRRSPTLLPALALSLSLGSKPHVSCLSWPYHILVLSSLAPGPEAPEDAGRSWHREEQLCKSVHMATLGLIKEVSQSKN

SEQ ID NO: 777650 - protein, 239 aa, Homo sapiens
AAAWTRVRRAGGDDGPAMARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVENAGAAGLPGQGPGGQGVNGGWGR

SEQ ID NO: 777651 - protein, 666 aa, Homo sapiens
MSCLCLGLLWTDSCCLPGRVLGPLHPPAAFSPPHPPAVPPSDRAPVPQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 777652 - protein, 769 aa, Homo sapiens
AAAWTRVRRAGGDDGPAMARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKREFHSCCPVGSAISAHCNLHLPGSSDSPASASWVAGITEPSALPVAKEMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 777653 - protein, 738 aa, Homo sapiens
AAAWTRVRRAGGDDGPAMARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRAVGALLRALASS

SEQ ID NO: 777654 - protein, 165 aa, Homo sapiens
MDVRRVLVKAEMEKFLQNKELFSSLKKGKICCCCRAKFPLFSWPPSCLFCKREMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 777655 - protein, 617 aa, Homo sapiens
AAAWTRVRRAGGDDGPAMARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFTITGQISNQRAEGLTSTVSESRPESRSRPSEPPTLPR

SEQ ID NO: 777656 - protein, 459 aa, Homo sapiens
MSLQAPSRLLELAGQSLLRNQFLTIFTLDELPREVFPLMFMEAFSMRRFEALKLMVQAWPFLSLPLGSLMKTLHLETLQAVLRGLDTLVAQKVRPRRWKLQVLDLRDVDENFWTIWSGARVLSCSPEAMSKRQTVEDCPRMGEHQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQWPCIPDLDSPFLCLYYPQMLYIKKISNIKEHLEHLLRYLKNPLGAFIFSDAYLTDRDMECLSQYPSLSQLKELRLIHILMWTTHLEPLGVLLEKVAATLKTLVLKDCRIQDPQLRVLLPALSHCSQLTTFNFHGNETSMNALKDLLRHTGGLSKLGLELYPAPLESLDYKGHVNWEILTPIRAELMRTLREVRQPKRIFFGPVPCPN

SEQ ID NO: 777657 - protein, 578 aa, Homo sapiens
MAVRWTWAGKSCLLLAFLTVAYIFVELLVSTFHASAGAGRARELGSRRLSDLQKNTEDLSRPLYKKPPADSRALGEWGKASKLQLNEDELKQQEELIERYAINIYLSDRISLHRHIEDKRMYECKSQKFNYRTLPTTSVIIAFYNEAWSTLLRTIHSVLETSPAVLLKEIILVDDLSDRVYLKTQLETYISNLDRVRLIRTNKREGLVRARLIGATFATGDVLTFLDCHCECNSGWLEPLLERIGRDETAVVCPVIDTIDWNTFEFYMQIGEPMIGGFDWRLTFQWHSVPKQERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 777658 - protein, 578 aa, Homo sapiens; identical to SEQ ID NO: 777657

SEQ ID NO: 777659 - protein, 152 aa, Homo sapiens
VRAVGVKMCAAHPSFQHRTKTQRGTCQESQVMEPSGGHVGSCPRWKGSWHSSWFPRLALTFVLSCPWPRLPSSMLGMLRDNPSASPTMSRLLPRILVLWRVDPALPILVPYQGQASHGSFCSPWHRLWGAQPGEQWALEGPGLHVPTPIMEF

SEQ ID NO: 777660 - protein, 88 aa, Homo sapiens
MSRLPSRTLHPSRPVLTACWVLVSCLKSRLRTPGKTPPQHVDPTPPKTLPQHVHWTPPKTPPTARALHDCTQDAAHSTCTHLHPRRPP

SEQ ID NO: 777661 - protein, 102 aa, Homo sapiens
TWRNWVSTKNIKISQTWWLVLVVPATQEAQAGGSLEHHCMPASLGDTVRPCLKNKKRRRKKKNQNYHQGFMSGNRSKSESKEMMEVYRSPLYATSAFKKGIM

SEQ ID NO: 777662 - protein, 49 aa, Homo sapiens
SRYPFPKPSLIGEKNLGPGRACSLPSSDSCQFSALHSIDCSRPGSLLGS

SEQ ID NO: 777663 - protein, 59 aa, Homo sapiens
VLALWEHDDLDLPCAGTRAVISFCILLEMLGYMVVPLASTVLAYRSLWMPTSHLMIELK

SEQ ID NO: 777664 - protein, 41 aa, Homo sapiens
MAPLCSILGDRARVLLKKKLRNEEKSWNRAQGILALGIFLK

SEQ ID NO: 777665 - protein, 106 aa, Homo sapiens
CWSFVPGWLHLGSCPQGSATLERVGASFLFVAESSSVVWLDHVVFMHSLADGHLGRFHFLAIVSHVALKVHVQDLCGHSHGLKLRFHLDDFSPDLSPRPWACLPAR

SEQ ID NO: 777666 - protein, 113 aa, Homo sapiens
TAGATQPAPEAAWLDLRKRGPGWRGEREVGATGLQMTSGLGACCGTRGSGSGLRLPLRGGALCLRFSRRPIYPRDTLILQAVSWTPFPPLASQPDLALSPLGEPVGWGPSAGV

SEQ ID NO: 777667 - protein, 753 aa, Homo sapiens
AENLQLSSTELATSMLYSPGPSLPESAESLDGSQEDKPRGSCAEPTFTDTGMVAHINNSRLKAKGVGQHDNAQNFGNQSFEELRAACLRKGELFEDPLFPAEPSSLGFKDLGPNSKNVQNISWQRPKDIINNPLFIMDGISPTDICQGILGDCWLLAAIGSLTTCPKLLYRVVPRGQSFKKNYAGIFHFQIWQFGQWVNVVVDDRLPTKNDKLVFVHSTERSEFWSALLEKAYAKLSGSYEALSGGSTMEGLEDFTGGVAQSFQLQRPPQNLLRLLRKAVERSSLMGCSIEVTSDSELESMTDKMLVRGHAYSVTGLQDVHYRGKMETLIRVRNPWGRIEWNGAWSDSAREWEEVASDIQMQLLHKTEDGEFWMSYQDFLNNFTLLEICNLTPDTLSGDYKSYWHTTFYEGSWRRGSSAGGCRNHPGTFWTNPQFKISLPEGDDPEDDAEGNVVVCTCLVALMQKNWRHARQQGAQLQTIGFVLYAVPKEFQNIQDVHLKKEFFTKYQDHGFSEIFTNSREVSSQLRLPPGEYIIIPSTFEPHRDADFLLRVFTEKHSESWELDEVNYAEQLQEEKVSEDDMDQDFLHLFKIVAGEGKEIGVYELQRLLNRMAIKFKSFKTKGFGLDACRCMINLMDKDGSGKLGLLEFKILWKKLKKWMDIFRECDQDHSGTLNSYEMRLVIEKAGIKLNNKVMQVLVARYADDDLIIDFDSFISCFLRLKTMFTFFLTMDPKNTGHICLSLEQWLQMTMWG

SEQ ID NO: 777668 - protein, 81 aa, Homo sapiens
QPGSQVQVSREVAGDILVVSGATLVATGLMMAPQMQQWRKIPPKTRKVPLQPRFSRRYSESRGNGPKLEMDSSVVEIAEGQ

SEQ ID NO: 777669 - protein, 311 aa, Homo sapiens
RGPGPAVAPAPRPQRAGHSQPRSGGGRSRRLTMHCHAELRLSSPGQLKAARRRYKTFMIDEILSKETCDYFEKLSLYSVCPSLVVRPKPLHSCTGSPSLRAYPLLSVITRQPTVISHLVPATPGIAQALSCHQVTEAVSAEAPGGEALASSESETEQPTPRQKKPRRSRTIFTELQLMGLEKKFQKQKYLSTPDRLDLAQSLGLTQLQVKTWYQNRRMKWKKMVLKGGQEAPTKPKGRPKKNSIPTSEEIEAEEKMNSQAQGQEQLEPSQGQEELCEAQEPKARDVPLEMAEPPDPPQELPIPSSEPPPLS

SEQ ID NO: 777670 - protein, 105 aa, Homo sapiens
SHNSRTSYSYDSLQLPLPRPCLWPGFPSSCSLPPGQFSQITNLHTGLSTNQAPQALSVNLTLLTCGSRSICPWSRTLNPELARQAFGTKLVSCMATVIPDVCVSL

SEQ ID NO: 777671 - protein, 127 aa, Homo sapiens
LACCGAPSQPPSRAHRLTLACCGVPTRPPSRPPSLLTKKPVSQIHGQRCLLSRHTQGNRPSKHRKSPAQWHGSGGELGVRFSHSKRRYENCSAVPEQTPSVSVSVPASSQQEPGASLLGQIPLTGTV

SEQ ID NO: 777672 - protein, 179 aa, Homo sapiens
LGFFAAAQDEPTLRESETQAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLESRVGCTR

SEQ ID NO: 777673 - protein, 95 aa, Homo sapiens
LSLEEILAEGTDLAETAPPPLCASRNSKAKLRALREAMYHSAEHGYVDVTIDIRSIGVPWTLHTWLESLRIAFQQHRRPLIQCLLKEFKTIQEEE

SEQ ID NO: 777674 - protein, 155 aa, Homo sapiens
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIY

SEQ ID NO: 777675 - protein, 78 aa, Homo sapiens
PDPRPRPGRARAAQVLRRSQQYSTGLSAQRQLLGGPCLKGGLSGGPPGCQEESYSKRVCRLRRSLSVDRGIQASWGYT

SEQ ID NO: 777676 - protein, 350 aa, Homo sapiens
RGCRLQWLAPSSPGQAMKVEFAPLNIQLARRLQTVAVLQWVFSFLTGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 777677 - protein, 176 aa, Homo sapiens
RGCRLQWLAPSSPGQAMKVEFAPLNIQLARRLQTVAVLQWVFSFLTGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGK

SEQ ID NO: 777678 - protein, 98 aa, Homo sapiens
WAPLYSCADRPTALTEALYDICFRTLKLTTPHLRGSSTTWMSATYERGHHLPDDFTRSSCTADLRKLTVNMVPFPRLPFLLSHWMVPTFMHLTNSESL

SEQ ID NO: 777679 - protein, 58 aa, Homo sapiens
MKAGAVSLGPPTAEPWYPHQPSPVAQYTPSECAHAGQAQWLTPVIPALWEAEAGGALE

SEQ ID NO: 777680 - protein, 197 aa, Homo sapiens
EIHPEPPPSDTMVSSCCGSVSSEQSCGLENCCCPSCCQTTCCRTTCCRPSCCKPQCCQSVCYQPTCCHPSCCISSCCRPYCCESSCCRPCCCRPSCCQTTCCRTTCCRTTCCCPSCCVSSCCRPQCCQSVCCQPTCCRPSYCISSCCHPSCCESSCCRPCCCVRPVCGRVSCHTTCYRPTCVISTCPRPLCCASSCC

SEQ ID NO: 777681 - protein, 113 aa, Homo sapiens [sequence omitted]

SEQ ID NO: 777682 - protein, 159 aa, Homo sapiens
MGADQGRARGAIVHRDVEGWLAGDTVGTTEYHALHGSVMYNKFGNEYPMNECSVATPDLIFRVVLVAILVVYDMHGLGFDFAAKDDPRIGHGHACIVDLASISVLRAIDCPIQAGTRKQESVVRWGVGGELGKYVTGASVVCVRDEDWDLGNSWAAGWM

SEQ ID NO: 777683 - protein, 68 aa, Homo sapiens
DIDTNVLGGRDEGSEAMELEIMDITTDHVKLNERNKERQELQDNTVFFCTLYGNLYQQTREILFSLGE

SEQ ID NO: 777684 - protein, 106 aa, Homo sapiens
LLTSGDPPASASQSAGITGMSQMLRERILFYIPIFPQVTGRMSLCIADRRPVPRVCSRDRGGRCCPGASSGFLCLSSEARCYLSEPQLLAQGLGRELRRGRSRAAP

SEQ ID NO: 777685 - protein, 101 aa, Homo sapiens
WKGHARLGAWSVQRQGGGNTLGSCGDQEKFMVAEIEPVWAGGLSAKGEMGRERLGPEDLHAHKLRVDPVNFKLLSHCLLVTLAAHLPAEFTPAVHASLGQV

SEQ ID NO: 777686 - protein, 119 aa, Homo sapiens [sequence omitted]

SEQ ID NO: 777687 - protein, 81 aa, Homo sapiens
QSPCIGDLPNTHLHFQKEQSRKEAESQVCGGEKGKWVSHEIQVAPQDRRISWARVLPIWVVLVISVCCGHSVAILSAPLPK

SEQ ID NO: 777688 - protein, 105 aa, Homo sapiens
MDSTFTSGVPSHTCSHSFPAPHLVPLCLLLLGEKVHLAQELTFSVFWPGNKTRLPFPIGCSFFATNTEWGKKCLPGTLRHNYAPIVKAYSSFKNALRGWARWLTP

SEQ ID NO: 777689 - protein, 72 aa, Homo sapiens
GHICPSQQGFSERAFRTWKQTPHCVGGLNTKSVEEQVSRHGSGNTNRKRATLESALPLLEFLVNTASSAWRV

SEQ ID NO: 777690 - protein, 108 aa, Homo sapiens
MWSQTVSVLRLGSSVLPQIDGQVPRASQKQGKGRWSVGAVAKGDRRQVVKEPPWVFWVCFSSRCPYPWPLPCRRALVLSGQLPAHPSPALFCFPAWKSVSSPGGHSSF

SEQ ID NO: 777691 - protein, 134 aa, Homo sapiens
SHLGQRLSPTSQLKKLRHGQVEAPYPAVGSPGQAKPPSPRLGQMLPLTCCLPRLISRPPHGALGKSCHPHQPDRRQPRERVGQEGPEALGGGRQGQPPEAGALFSEARGAGGRDNDRPPTQGPPRIPMAPESIA

SEQ ID NO: 777692 - protein, 106 aa, Homo sapiens
RGPRGSGPPTMLTLDGGVESSPQTLRGNSRYTPSATLWPNQSHPSRGHLGLPSVCSAHKAHQCLRFPKSPSQWVLLSSISLAPFNKKMALMQTRLTAQLQSTENEA

SEQ ID NO: 777693 - protein, 71 aa, Homo sapiens
LKTPSGPAAAAAAALPELQISTAIGLRPLHPRDRGPQEEPFLTAPVGLQPYGWEGPWEPPSPPPPWGRGRE

SEQ ID NO: 777694 - protein, 947 aa, Homo sapiens
HEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITAGSKVIQNEFTVGEECELETMTGEKVKTVVQLEGDNKLVTTFKNIKSVTELNGDIITNTMTLGDIVFKRISKRI

SEQ ID NO: 777695 - protein, 59 aa, Homo sapiens
MRQPSKNNSAIPVSSCVTLDFCQGVGLSFPLLPNAEYLYVVTSAAPEGPQDREVSAVND

SEQ ID NO: 777696 - protein, 88 aa, Homo sapiens
GQTHQGPRALTHKAQIEMESRISWWGPQSLVGQPARGAAHSHHACPELAAALQKLLDSSHCPVGIQLCLHKPGSSIERGEAPPPPEQW

SEQ ID NO: 777697 - protein, 331 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 777698 - protein, 331 aa, Homo sapiens; identical to SEQ ID NO: 777697

SEQ ID NO: 777699 - protein, 268 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTAGGEKNQVF

SEQ ID NO: 777700 - protein, 331 aa, Homo sapiens; identical to SEQ ID NO: 777697

SEQ ID NO: 777701 - protein, 331 aa, Homo sapiens; identical to SEQ ID NO: 777697

SEQ ID NO: 777702 - protein, 236 aa, Homo sapiens
LLCAIRPESTVARGLGCRDPKSVGCGLGAPSNARPLCSARDISPQRNSPRRGPWVTRDSGLGIEGDYTAQEIAMKSVDLQAGAAERGGEVENAGLGLDSGPGVVWSPRSLNPEGSGLTSAPKSRVPHGGSGPWKFRTPQQFRAVIAFPKPGSPGPRQSGERQALCWVSEDAPKTGTSLQCVRHQLSSPAAARGCCSPGYPGPPSCPAFGLPCSPRCGVAEDGPRLTLGWVPGKRAR

SEQ ID NO: 777703 - protein, 130 aa, Homo sapiens
MNDAASDLGTCTTLGVDASTPNTKGSGQDAPQSGWKATERGRTGPQCQGTAGWLSSSPATPQANGRAAALSFTGGGTEAWREQGLNSHIADAQPSLAEPRDSGAVSTALLCSAAGLWRHQTTMETVSFST

SEQ ID NO: 777704 - protein, 124 aa, Homo sapiens
WFSQNVLLCVEQAGTSVEPRYLSDRLLSFSDHFPHAFQEAVLALRVLNVLNMHINSLGKNLALNLFVYNNANSMLGNIVDSSRFAMVTPVGRSFLNSTHSLDVYNITFLIDSHIHGQRNNSMFS

SEQ ID NO: 777705 - protein, 113 aa, Homo sapiens
SGNKPLRNLTDKCSSFGSSPEAPLMALLVGFGSSCLLGGSSVPSSARSPMGFSSTSLPRPRPCSQTSVKCSSSRSLSSNVNLQPATLLCPLEAPQSHRGLSSAAELLDKWETL

SEQ ID NO: 777706 - protein, 102 aa, Homo sapiens
KTKNKTKNTKADPRPERCGRGFDKSSKAIPMAPYFRNMVSWVNCVDSRVSCKINKSNMVWICVPTKSHSPVLEVGSGGRRLGSWGWFIMNGSAPSPLALSLG

SEQ ID NO: 777707 - protein, 107 aa, Homo sapiens
MISLGEGLGTSWALFSPRSSLRVSVSLIPRCLEPSAHYIRLEVWGHPTIPPQAPPRHHCVQILQTAPPEGAGVCPLRPICRGSTSSVVRTPTAASWEGTSLGPLSVH

SEQ ID NO: 777708 - protein, 156 aa, Homo sapiens
PAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 777709 - protein, 101 aa, Homo sapiens
VSQGVASASDGDGVFGRCISRGGQKLEVLCGQSDAPNDGFQQLSRSKRERERWNLQHTQLIAQITEGGCESLSAIRGVELHSPFVSPAMDKVQLTYVQCLS

SEQ ID NO: 777710 - protein, 126 aa, Homo sapiens
PRNYRMWPRTYQSQCFQAGCSLGCCPQVPCCRVKWRYQVPDGEHIRHPVIPLPGLGGTALGSSKLQGLLLTLVKASTPGKPLALVRTSDRLCTPSAPQGTDAGHARSPAGGLFCVTVPLHSRKKCP

SEQ ID NO: 777711 - protein, 102 aa, Homo sapiens
TMLVLEQWPGLPHVFLPKAKPRRGPCSSPCSSWSSCGNQASFVFFLSRVAQHRHHQPLRVGSREERAAASEPVLPARSCLMTHGPIVCVPASVCAAGRARYA

SEQ ID NO: 777712 - protein, 106 aa, Homo sapiens
MDVLFFSILGGWFEQHLLTISLVGMFLLKTELGSHKMFLQYKVIIPLAFILLFSCSKCMHLSKRIWAAVQSERCQQRLPRPIQSSKSLFDLLFHTDSSDEHAHELT

SEQ ID NO: 777713 - protein, 156 aa, Homo sapiens
MGDPVLTQVVHKETRDRHRVGDSTPIKKAGGPATFVNIPQEYEGHRDYTRGQGTANKYRRGGKQGNNIEQKYQKKRKRRENAEYDQGASERDSHRRTKKEETKDEAKKRERGETTQRRERNATRGENTTKKQDNKKNTTERNEKAKEKKDEATAPT

SEQ ID NO: 777714 - protein, 156 aa, Homo sapiens
MGDPVLTQVVHKETRDRHRVGDSTPIKKAGGPATFVNIPQEYEGHRDYTRGQGTQINTGAGGNKETTRAEIPEETKKTRERRYDQGASERDSHRRTKKEETKDEAKKRERGETTQRRERNATRGENTTKKQDNKKNTTERNEKAKEKKDEATAPTD

SEQ ID NO: 777715 - protein, 187 aa, Homo sapiens
GKWALTVPRGYKRLNSTHCQDINEAQCLGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSDG

SEQ ID NO: 777716 - protein, 33 aa, Homo sapiens
EPILKNILTYNKEFPFDVQPVPLRRILAPGEEE

SEQ ID NO: 777717 - protein, 1894 aa, Homo sapiens
STHALDLEAEEERTRLCDDRLGLASRELLLQDSKDRVECARIHPPSSCPGDLAPHLMMQQRPAGRGPSPPHPPPSPLAAPHPQPLPVDGGASYGLGHPALHQNLPPGFPASVAGPVPSVFPLPQDAPTQLVILPSEPTPHSAPHALADVMDQASLWPPMYGGRGPASHMQHPGQLPVYSRPQLLRQQELYALQQQRAAQFQRKPEDQHLDLEEPAQEKAPKSTHKPVALTPTAPGAPSPAAGPTKLPPCCHPPDPKPPASSPTPPPRPSAPCTLNVCPASSPGPGSRVRSAEEKNGEGQQSTADIITSEPVARAHSVAHAGLEFLASNDPSTSASQSFGITDLPPGYLRPMAGLGFSLPSDVHSSNLEDPETMQTTAPGAQPEPTRTFLPGEPPPCSPRSLEEPGLLSGAREATQDLAATPYPAERGPQGKAADPSPLEGLQELQCAALLEAGGPEATGQAHSTQGGAREERSREEGEQGPSSGASSQVLEQRAGSPGALEDEGEQPAPEEDELEEDELGQQSMEDSEEDCGGAPDNSHPPRALPGLDALVAATINLGDLPSDSPPDPQPPAASGPPSTVPLPHSSGIHGIALLSELADLAIQRQRSERTVPEEEEDVLSFNLQHLATLATAWSLVEAAGLDSSTAPAQPPTANPCSGPRLTPRMQILQRKDTWTPKTKPVCPLKAAIDQLDTQEVGMRVRLAELQRRYKEKQRELARLQRKHDHERDESSRSPARRGPGRPRKRKHSSSLPAPRPTGPLPRSDGKKVKAVRTSLGLLCAELRGGSGGEPAKKRSKLERSVYAGLQTASVEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHAGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPKEDSLLYAGSVRTLQPPDIYSIVFKVERAPAEDLLIEPAAAGSVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRANKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 777718 - protein, 1894 aa, Homo sapiens; identical to SEQ ID NO: 777717

SEQ ID NO: 777719 - protein, 703 aa, Homo sapiens
GLAGAAATPRPRDQTLRQPWGRAPPAHGSSPAFLQVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRANKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 777720 - protein, 1894 aa, Homo sapiens; identical to SEQ ID NO: 777717

SEQ ID NO: 777721 - protein, 1894 aa, Homo sapiens; identical to SEQ ID NO: 777717

SEQ ID NO: 777722 - protein, 1894 aa, Homo sapiens; identical to SEQ ID NO: 777717

SEQ ID NO: 777723 - protein, 1894 aa, Homo sapiens; identical to SEQ ID NO: 777717

SEQ ID NO: 777724 - protein, 1110 aa, Homo sapiens
SAPVDRGQGPRGTSSEPGINREAPNRPGAVVCRGRPESAAAPPCSQEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHAGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPSIVFKVERAPAEDLLIEPAAAGSVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRANKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 777725 - protein, 943 aa, Homo sapiens
SAPVDRGQGPRGTSSEPGINREAPNRPGAVVCRGRPESAAAPPCSQEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHAGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPSIVFKVERAPAEDLLIEPAAAGSVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 777726 - protein, 1894 aa, Homo sapiens; identical to SEQ ID NO: 777717

SEQ ID NO: 777727 - protein, 1894 aa, Homo sapiens; identical to SEQ ID NO: 777717

SEQ ID NO: 777728 - protein, 101 aa, Homo sapiens
PVHKDWKKWLFLSSAQIPTKLSRRRRNRETWPKERSKINLHKPILKKQRHELPDKEFKIALIKMLYELKVTMHEQNENINKETENPKKKKKKKRRTNQFWN

SEQ ID NO: 777729 - protein, 328 aa, Homo sapiens
MTVEKEAPDAHFTVDKQNISLWPREPPPKSGPSLVPGKTPTVRAALICLTLVLVASVLLQAVLYPRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSARFWIPGEPNNAGNNEHCGNIKAPSLQAWNDAPCDKTFLFICKRPYVPSEP

SEQ ID NO: 777730 - protein, 328 aa, Homo sapiens; identical to SEQ ID NO: 777729

SEQ ID NO: 777731 - protein, 105 aa, Homo sapiens
MGTISLCIGVCAFEGANTSTSFYKLVYTAILSYSIQDLLPEQDMKDLCQKVTLTRHRSWGLDNLHLVKDWRTVNEGKGQKEYCNRLTQCSSTKSKIFQCIECGRN

SEQ ID NO: 777732 - protein, 105 aa, Homo sapiens; identical to SEQ ID NO: 777731

SEQ ID NO: 777733 - protein, 210 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 777734 - protein, 210 aa, Homo sapiens; identical to SEQ ID NO: 777733

SEQ ID NO: 777735 - protein, 133 aa, Homo sapiens [sequence omitted]

SEQ ID NO: 777736 - protein, 210 aa, Homo sapiens; identical to SEQ ID NO: 777733

SEQ ID NO: 777737 - protein, 210 aa, Homo sapiens; identical to SEQ ID NO: 777733

SEQ ID NO: 777738 - protein, 264 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQGETLRAAGATLNKAVNSPLVRGGSWQMTPAADKQARQAGPRWLTLVIPALWESKAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 777739 - protein, 131 aa, Homo sapiens
MQDPEMDMKSVTDRAARTLLWTELFRGLGMTLSYLFREPATINYPFEKGPLSPRFRGEHALRRYPSGEERCIACKLCEAICPAQVSPCPNRPPRQPLPLGEGGQAALGPNPSPCLMCVPRKSLSPSEPLPS

SEQ ID NO: 777740 - protein, 110 aa, Homo sapiens
MRCLTTPMLLRALAQAARAGPPGGRSLHSMSPRFRGEHALRRYPSGEERCIACKLCEAICPAQVSPCPNRPPRQPLPLGEGGQAALGPNPSPCLMCVPRKSLSPSEPLPS

SEQ ID NO: 777741 - protein, 210 aa, Homo sapiens; identical to SEQ ID NO: 777733

SEQ ID NO: 777742 - protein, 210 aa, Homo sapiens; identical to SEQ ID NO: 777733

SEQ ID NO: 777743 - protein, 210 aa, Homo sapiens; identical to SEQ ID NO: 777733

SEQ ID NO: 777744 - protein, 210 aa, Homo sapiens; identical to SEQ ID NO: 777733

SEQ ID NO: 777745 - protein, 171 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQVSPCPNRPPRQPLPLGEGGQAALGPNPSPCLMCVPRKSLSPSEPLPS

SEQ ID NO: 777746 - protein, 153 aa, Homo sapiens
MIMVMETDSDSQGQGPSLQYVNMQDPEMDMKSVTDRAARTLLWTELFRGLGMTLSYLFREPATINYPFEKGPLSPRFRGEHALRRYPSGEERCIACKLCEAICPAQVSPCPNRPPRQPLPLGEGGQAALGPNPSPCLMCVPRKSLSPSEPLPS

SEQ ID NO: 777747 - protein, 192 aa, Homo sapiens
MRRPLCATGLVRVGDHWEEYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 777748 - protein, 568 aa, Homo sapiens
KNTHKQMCIERDARVTSSDEATRSPPPDTPGSRGTTAMCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 777749 - protein, 598 aa, Homo sapiens
ASRPEAIASQRARFGVPGGLRSFRSPGPAAGSRLCSRSFLESAAAARARCPTRSPPPDTPGSRGTTAMCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 777750 - protein, 367 aa, Homo sapiens
MEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 777751 - protein, 598 aa, Homo sapiens; identical to SEQ ID NO: 777749

SEQ ID NO: 777752 - protein, 598 aa, Homo sapiens; identical to SEQ ID NO: 777749

SEQ ID NO: 777753 - protein, 553 aa, Homo sapiens
RLEAGSDCEPARALRRSRRSAKFPEPRSRRGFALVLALVPGVGGRCARSLPNPVPAPRHAGLSGHHSHVLVSVRRYRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 777754 - protein, 214 aa, Homo sapiens
CRYSVVPPNKKKSYGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 777755 - protein, 113 aa, Homo sapiens
MKEVLSEGRGRTGRRRAHRHLLLEPPGRTGVRGRSDCCVCVLGGRGAVENEEDLPELSDSGDEAAWEDEDDADLPHGKQQTPCLFCNRFVRLQRLASALGCPGAWGLCAQERL

SEQ ID NO: 777756 - protein, 110 aa, Homo sapiens
KTWAPAQCLCSRMGPAWLWLLGTGILASVHCQPLLAHGDKSLQGPQPPRHQLSEPAPAYHRITPTITNFALRLYKELAADAPGNIFFSPVSISTTLALLSLGAQANTSAL

SEQ ID NO: 777757 - protein, 173 aa, Homo sapiens
RTLALECPFCRRACRGCDTSDCLPVLHLIELLGSALRQSPAAHRAAPSAPGALTCHHTFGGWGTLVNPTGLALCPKTGRVVVVHDGRRRVKIFDSGGGCAHQFGEKGDAAQDIRYPVDVTITNDCHVVVTDAGDRSIKVFDFFGQIKLVIGGQFSLPWGVETTPQNGIVVTDA

SEQ ID NO: 777758 - protein, 70 aa, Homo sapiens
QSPEAGTTVRRAAGRAVPRRTWALLAMSLKQDGRRRWLYHQCLLLAMLTRNQELGAGGLYETVQGTDECG

SEQ ID NO: 777759 - protein, 38 aa, Homo sapiens
MGPLVLFKAYSILLNTMKNMQESHISLWHATYWRDELL

SEQ ID NO: 777760 - protein, 78 aa, Homo sapiens
RIFQIHTSRMTLADDVTLDDLIMAKDDLSGADIKAICTEAGLMALRERRMKVTNEDFKKSKENVLYKKQEGTPEGLYL

SEQ ID NO: 777761 - protein, 118 aa, Homo sapiens
RYQYMQRTELMDKNRPHFGKPGMKLNSRAIATALPMGWLSTNVQKCPCHASWRWWWSGEGRRASFVGILTWQGLLHLSLVACCLKYNLQTCSLGLIWELARNAESQAKPGTRVRDGLL

SEQ ID NO: 777762 - protein, 119 aa, Homo sapiens
AVTSGGGSRRPGMAAWSPAAAAPLLRGIRGLPLHHRMFATQTEGELRVTQILKEKFPRATAIKVTDISGGCGAMYEIKIESEEFKEKRTVQQHQMVNQALKEEIKEMHGLRIFTSVPKR

SEQ ID NO: 777763 - protein, 119 aa, Homo sapiens; identical to SEQ ID NO: 777762

SEQ ID NO: 777764 - protein, 68 aa, Homo sapiens
DAWVTHASQLEKVTDISGGCGAMYEIKIESEEFKEKRTVQQHQMVNQALKEEIKEMHGLRIFTSVPKR

SEQ ID NO: 777765 - protein, 113 aa, Homo sapiens
AVTSGGGSRRPGMAAWSPAAAAPLLRGIRGLPLHHRMFATQTEGELRVTQILKEKFPRATAIKVTDISGTKRRNQRDAWIADIYLCPQTLTTPWLHRCCCLRPWMNFTDIILP

SEQ ID NO: 777766 - protein, 113 aa, Homo sapiens; identical to SEQ ID NO: 777765

SEQ ID NO: 777767 - protein, 121 aa, Homo sapiens
AVTSGGGSRRPGMAAWSPAAAAPLLRGIRGVSVGRVGAALPGTGAAEGPRGWRLSGLEDWLPEGARGTGNGGLLFLSLIHSFIHSFTQRQRHSKFQALARSRGAPELGGGWRSGGQTHEQS

SEQ ID NO: 777768 - protein, 34 aa, Homo sapiens
MQGGCALDGPSVACVLAIRYLSHLSLTRGHYKLI

SEQ ID NO: 777769 - protein, 103 aa, Homo sapiens
MFCQGWAKRGTAERQKDVPATKTTWAKDRGLQCKDWNLQHGKLERGKISVSDSRQGHFPLQERRSPHQHKRLALPFSVQASWLERGNSKVLRKNKSGPNSENS

SEQ ID NO: 777770 - protein, 74 aa, Homo sapiens
KTSDAGVGRLKEPPSPLRHCTGVDSIVSLAVVGGFQKVRSEAVSRTSFQETCHLQAVQLSADRARTGKRWLLLL

SEQ ID NO: 777771 - protein, 75 aa, Homo sapiens
SSRYPSLEDFNSSRARGACLSSQCAGIIGVDHCGPVLCFKKPTVKMHKWGNGIVVKRGLILAKYYKMYQSNDDDT

SEQ ID NO: 777772 - protein, 42 aa, Homo sapiens
LSQTTTTTTRGEQGSCGDPVRPHQKHPATSQTPFSVEDQVIS

SEQ ID NO: 777773 - protein, 193 aa, Homo sapiens
GLWPGDLLPPQLLSDHLLQDHLLPPQLLCVQLLQTPVLPVCVLPAHLLAVPAAVRPPAAGPPAAALAAVYPAAADPSAASLCAASPLAAVPAAASPAAVAPAAVCPGAAGPSAASLCAASQPAAVPAAASPAAAAPLAVNPAAAARAAAAPAAACVQSVAESPATPLAIAQPVSFPPAPVPCAVPPLAAELLA

SEQ ID NO: 777774 - protein, 87 aa, Homo sapiens
KYQLQNSQHPAWHRVQELRAQQREDRCSQGGLRKMRLSNSLMHHLLYLLKLGQASGVPSCCQGTQHTGKYSSQDGRCCRGGALGLLH

SEQ ID NO: 777775 - protein, 79 aa, Homo sapiens
TDTNRARTGIFQYGDLTACVLGGGRRFTMTLIGYHKMLLSHLVFSLPSPGINHFSKEPHPHCFEKVPTSRQHPRLTQNL

SEQ ID NO: 777776 - protein, 77 aa, Homo sapiens
AATFHVQALLLLGIQAPGQLVSVGHRTGEQDRGCHFVGMEEAETEAQSPASHCLERGLPPACAGVAEQSQASFFLHS

SEQ ID NO: 777777 - protein, 252 aa, Homo sapiens
MSPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTTEPGRTLDPQELAQIAEKVPGLQNEQKLFHLEELRKCGAQFNLQPSSSPENSLDPFPPWTLKEEAKGKEKEDDGLLTSEPMGSPVSSKTESVSDKEDKPPLAPAGGTEGPEPPPPPCPS

SEQ ID NO: 777778 - protein, 541 aa, Homo sapiens
GTSRYSEGERYQRFSKMRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 777779 - protein, 142 aa, Homo sapiens
MNCSESQRLRTLLSRLLLELHHRGNASGLGAGPRPSMGMGVVPDPFVGREVTSAKGDDAYLYILLIMIFYACLAGGLILAYTRSRKLVEAKDEPSQACAEHEWAPGGALTADAEAAAGSQAEGRRQLASEGLPALAQGAERV

SEQ ID NO: 777780 - protein, 307 aa, Homo sapiens
PRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 777781 - protein, 307 aa, Homo sapiens; identical to SEQ ID NO: 777780

SEQ ID NO: 777782 - protein, 260 aa, Homo sapiens
MDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 777783 - protein, 167 aa, Homo sapiens
SSYCNFLNRMKLAHGSLILHRYMYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 777784 - protein, 157 aa, Homo sapiens
MDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGWGTR

SEQ ID NO: 777785 - protein, 97 aa, Homo sapiens
HNVYYSLLLGQLYGLEKFWAYLKYSQSKTQSIDPKLQEYRLEDFRVDPPISDEFGRKRHSSTSGEEIPPNSSTKPPNAAKPTSTSELQVPINSPRVQ

SEQ ID NO: 777786 - protein, 201 aa, Homo sapiens
MDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDEADPIE

SEQ ID NO: 777787 - protein, 307 aa, Homo sapiens; identical to SEQ ID NO: 777780

SEQ ID NO: 777788 - protein, 307 aa, Homo sapiens; identical to SEQ ID NO: 777780

SEQ ID NO: 777789 - protein, 155 aa, Homo sapiens
RRVSALSRPTRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 777790 - protein, 164 aa, Homo sapiens
MKDILSPLWLGEKCKKKITGYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 777791 - protein, 260 aa, Homo sapiens; identical to SEQ ID NO: 777782

SEQ ID NO: 777792 - protein, 247 aa, Homo sapiens
MDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQEADPIE

SEQ ID NO: 777793 - protein, 171 aa, Homo sapiens
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 777794 - protein, 80 aa, Homo sapiens
DTEGAPAPVHVPACVGVFTQRCARLVSYPSPPPRWGGAVAIHGGQKRKLRLSRVKSLPLGHTAKNSQPRSMPRDSPRGIM

SEQ ID NO: 777795 - protein, 82 aa, Homo sapiens
AIYDKPTANIILNGQKLEAFPLKTGTRQGCPLSPLLFNIVLEVLARAIRQEKEIKGIQLGKEEIKLSLFADDMIVFLENPIV

SEQ ID NO: 777796 - protein, 53 aa, Homo sapiens
RLDLGQNSENMPGRGPHQGQLGGEEGDWRLSPLPRQFWDVRRPFSQAAPAHCG

SEQ ID NO: 777797 - protein, 217 aa, Homo sapiens
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSNLPDLIDPESFSQDILHDQDHSTLGPFMAPQVSESTGLIT

SEQ ID NO: 777798 - protein, 1101 aa, Homo sapiens
ARGQRGPGRDGDCRLQAAMPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASTLPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 777799 - protein, 78 aa, Homo sapiens
TRGRGPRRPRPGARRRLLEPGSPWGLRLQEPSLYPASEGRSVLHTKPPPEGSALPPPWAAASARKHQASFVLSTPCNQ

SEQ ID NO: 777800 - protein, 243 aa, Homo sapiens
GEFVVLLGEFVVLLGEFVVLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 777801 - protein, 92 aa, Homo sapiens
VKIKRNWRNLRGIDNRVRRRFKGQILMSNIGYASNKKTKHMLHSGFRKFLVHNVKELEVLLMCNKSYCAGLCLQLSESPSTFRKPATSFHKH

SEQ ID NO: 777802 - protein, 1101 aa, Homo sapiens; identical to SEQ ID NO: 777798

SEQ ID NO: 777803 - protein, 1101 aa, Homo sapiens; identical to SEQ ID NO: 777798

SEQ ID NO: 777804 - protein, 101 aa, Homo sapiens
STNLSCLPQNIRSLMSTEKTKGFCQLVVSSSLRDGMSHLIQSAGLGGLKHNTVLMAWPASWKQEDNPFSWKNFVGRHGWRPFGIPSPSPLCPLSVPSLSPR

SEQ ID NO: 777805 - protein, 284 aa, Homo sapiens
ARGQRGPGRDGDCRLQAAMPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTGTEDGVGSLGLGLAQGNRRQTHLSPSDATQAAHGASYGSF

SEQ ID NO: 777806 - protein, 71 aa, Homo sapiens
RKKEQRKKNKTNPSQVRGPVVIRDEGEHVQFIRAYAPGRGPQLWLCHAGLCLQLSESPSTFRKPATSFHKH

SEQ ID NO: 777807 - protein, 1009 aa, Homo sapiens
ARGQRGPGRDGDCRLQAAMPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASTLPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPRELRGNKVVHKEVASIY

SEQ ID NO: 777808 - protein, 981 aa, Homo sapiens
ARGQRGPGRDGDCRLQAAMPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASTLPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDPNSGYASS

SEQ ID NO: 777809 - protein, 96 aa, Homo sapiens
LGEDRHFLPNCCISQDHPGLPCPHLVPIKTPKTLAGRLEAAELDVERNTLTLAHLQATDRQKQNDTNLVGTVRGESRLLISQTSGENHLPSGSPIC

SEQ ID NO: 777810 - protein, 150 aa, Homo sapiens
MSVQPKLSLGGFEITPPALLQLKCDSGPVHISGQHLVAVEEDAESEDEEEENVKLLSISGKQLVPGSGSKFPQKKVKLVADEDDDDDDDFDDEETEEKAPVKKSIQDTTAKNAHKSNQNGKDSKPSSTPRSKGQESFKKQEKTPKTPKGP

SEQ ID NO: 777811 - protein, 41 aa, Homo sapiens
ERPEVTLLASCHEAAGNRVLAVLCGLPQHTSTLVPSWFRPF

SEQ ID NO: 777812 - protein, 98 aa, Homo sapiens
TCCRPSCCISSCCRPSCCISSCCKPSCCQTTCCRPSCCISSCYRPQCCQPSCCRPACCISSCCHPSCCVSSCRCPFSCPTTCCRTTCFHPICCGSSCC

SEQ ID NO: 777813 - protein, 66 aa, Homo sapiens
SDIDPDNSCRKWYRNHPRSRQRLEGPGPCPRSAGCQAGSQNPSWGVSPGWLNLDSTGCGNIWKMVA

SEQ ID NO: 777814 - protein, 104 aa, Homo sapiens
TAATWRRVPCVWSFTFSAPHPPRRRSLVTPREARTCQAGEFELTPGWPSPVQLDREPNHVRPRGVLEPWVVSSGVAWGLSRADALEQEKWAVLLDLMDPAASFS

SEQ ID NO: 777815 - protein, 93 aa, Homo sapiens
TDGVPAQQLRIPLSFQNPLFHMAADGPGPPGGHGGGGGHGPPSSHHHHHHHHHHRGGEPPGDTFAPFHGYSKSEDLSSGVPKPPAASILHSHS

SEQ ID NO: 777816 - protein, 85 aa, Homo sapiens
LQEPVRLDQHCQELSRARHRAQDLAALISAACGSCSPPPPSGKSSPLGWAPCIPRGASSAPPSPVALAARVGLATQLGYKSARCD

SEQ ID NO: 777817 - protein, 103 aa, Homo sapiens [sequence omitted]

SEQ ID NO: 777818 - protein, 75 aa, Homo sapiens
DIECEAYNTSSASLRVLRQVLLTQRIRLLLLLLSGLLHRKGLLSEHKWGNLEFIYLRGSFGTQLNFTVSSFPCVS

SEQ ID NO: 777819 - protein, 785 aa, Homo sapiens [sequence omitted]

SEQ ID NO: 777820 - protein, 785 aa, Homo sapiens [sequence omitted]

SEQ ID NO: 777821 - protein, 125 aa, Homo sapiens
MGTSSIFLCVLFLCGALGLTMSPARGRLRCYICGFTKPCHPVPTECRDDEACGISIGTSGKSCLSRAQCPLPGYATYWLHSYTLWHHCCEQDLCNIAASPQQLTSLLASLPLFVASFAGRGHLLH

SEQ ID NO: 777822 - protein, 89 aa, Homo sapiens
AQRRKEREELAQQYEAILRECGHGRFQWTLYFVLGLALMADGVEVFVVGFVLPSAEKDMCLSDSNKGMLWPSSSTLGHDGGTPSSERTV

SEQ ID NO: 777823 - protein, 71 aa, Homo sapiens
VDSDIPYASVLKCLLVPNVQHSSTLAPPTRGTKNSLLGVGLGGAHPAHSRTFSSIPGLHPRDAGSTDPSPV

SEQ ID NO: 777824 - protein, 505 aa, Homo sapiens
MEQTEKSKVYAENGLLEKIKLCLSKKPLPSPTERKKFDHDFAISTSFHGIHNIVQNRSKIRRVLWLVVVLGSVSLVTWQIYIRLLNYFTWPTTTSIEVQYVEKMEFPAVTFCNLNRFQTDAVAKFGVIFFLWHIVSKVLHLQEITANSTGSREATDFAASHQNFSIVEFIRNKGFYLNNSTLLDCEFFGKPCSPKDFAHVFTEYGNCFTFNHGETLQAKRKVSVSGRGLSLLFNVNQEAFTDNPALGFVDAGIIFVIHSPKKVPQFDGLGLLSPVGMHARVTIRQVKTVHQEYPWGECNPNIKLQNFSSYSTSGCLKECKAQHIKKQCGCVPFLLPGYGIECDLQKYFSCVSPVLDHIEFKDLCTVGTHNSSCPVSCEEIEYPATISYSSFPSQKALKYLSKKLNQSRKYIRENLVKIEINYSDLNYKITQQQKAVSVSELLADLGGQLGLFCGASLITIIEIIEYLFTNFYWICIFFLLKISEMTQWTPPPQNHLGNKNRIEEC

SEQ ID NO: 777825 - protein, 53 aa, Homo sapiens
MLMDAGQDYMVFEDVAIHFSQEEWGILNDVQRHLHSDVMLENFALLSSVGKAL

SEQ ID NO: 777826 - protein, 53 aa, Homo sapiens; identical to SEQ ID NO: 777825

SEQ ID NO: 777827 - protein, 188 aa, Homo sapiens
LVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 777828 - protein, 143 aa, Homo sapiens
HSVAYARRAHEQELDHLYRWLTCSIKGYDFRSSCVFRGGEWNLESRLEKAEHGHADLKASNLRVRGEVGELQRMVHGWYSRKIQDNSFCEPVRVASLDIGFASDLIMDFPVSRTVSYKGLSPYLLSLGKIRVIFGRKSISGFC

SEQ ID NO: 777829 - protein, 95 aa, Homo sapiens
HSVAYARRAHEQELDHLYRWLTCSIKGYDFRSSCVFRGGEWNLESRLEKAEHGHADLKASNLRVRGEVGELQRMVHGWYSRCELRTGAFVFRAPR

SEQ ID NO: 777830 - protein, 385 aa, Homo sapiens
PVGARQRGGQVACVLRPRGKMNGTRNWCTLVDVHPEDQAAAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 777831 - protein, 141 aa, Homo sapiens
MWCLSHLSLSLSLSSLLGQAGRKTYAMVSSHSAGHSLASELVESHDGHEEIIKVYLKGRSGDKMIHEKNINQLKSEVQYIQEARNCLQKLREDISSKLDRNLGDSLHRQEIQVIGNGPWLGPHRGGGVVPGSLIYQLPSVC

SEQ ID NO: 777832 - protein, 334 aa, Homo sapiens
MWCLSHLSLSLSLSSLLGQAGRKTYAMVSSHSAGHSLASELVESHDGHEEIIKVYLKGRSGDKMIHEKNINQLKSEVQYIQEVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 777833 - protein, 385 aa, Homo sapiens; identical to SEQ ID NO: 777830

SEQ ID NO: 777834 - protein, 410 aa, Homo sapiens
PVGARQRGGQVACVLRPRGKMNGTRNWCTLVDVHPEDQAAGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 777835 - protein, 387 aa, Homo sapiens
LEDLEVTGSRAPEDQAAGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 777836 - protein, 154 aa, Homo sapiens
VTEDVGNRAGADTIMNLSLPFLCLFLLSFSFKLALQLRKVSLLSLRLWGQSICCLEKEGNQDSSGTQMSSSLALLNPLLHNWSFILALNDPAGHHGFLFLLFFFFSETESHSVTQAGVQWRDLSSLQPLPPGFKRFFCLSLPSSWDYRCATTPG

SEQ ID NO: 777837 - protein, 1481 aa, Homo sapiens
QVILYDPAAGPPGSAGPRRAATAAVPKMFAFDAVFPQDSEQAEVCSGTVADVLQSVVSGADGCIFSFGHMSLGKSYTMIGKDSSPQSLGIVPCAISWLFRLIEERRERTGTRFSVRVSAVEVCGRDQSLRDLLAEVAPGSLQDTQSPGVYLREDPVCGAQLQNQSELRAPTAEKAAFYLDAALAARSTSRAGCGEDARRSSHMLFTLHVYQYRMEKCGRGGMSGGRSRLHLIDLGSCEAAAGRAGEAAGGPLCLSLSALGSVILALVNGAKHVPYRDHRLTMLLRESLATAGCRTTMIAHVSDAPAQHAETLSTVQLAARIHRLRRKKAKYASSSSGGESSCEEGRARRPPHLRPFHPRTVALDPDRTPPCLPGDPDYSSSSEQSCDTVIYVGPGGAALSDRELTDNEGPPDFVPIIPALSRHRPSKGPRDADHFRCSTFAELQERLECMDGNEGPSGGPGGTDGAQASPARGGRKPSPPEAASPRKAVGTPMAASTPRGSSGPDTHQGTPEPCKAIVWGDQREDSSAWPELLVPEKAAVSGGRRPLPSPAPPPPQLLEACRAPEEPGGGGTDGVARTPPVGMSGQVAGSPMLPGATCPRLAAGSRCPERGLLTTTVTLQRPVELNGEDELVFTVVEELSLGALAGAGRPTSLASFDSDCSLRALASGSRPVSIISSINDEFDAYTSQAPEGGPLEGAAWAGSSHGSSISSWLSEVSVCTADSRDPTPQPRFSPDSLAGLDPGGPPALDGSLGDGSSGFLGPDRPDSPGPTWGPCPGEVAAVAPSRPGREPQAGPSRWASAAQTIHSSLPRKPRTASATTRVGCARLGQSPPGRGGLFEDPWLLRVGECDTQAASAGRAPSPTLGSPRLPEAQVMLACAQRVVDGCEVAARAARRPEAVARIPPLRRGATTLGVTTPAVSWGDAPTEVVACSGSLKASPTSKKGLAPKAGFLPRPSGAAPPAPPTRKSSLEQRSSPASAPPHAVNPARVGAAAVLRGEEEPRPSSRADHSVPRATSSLKARASKVEAAHRLAGHASLERYEGLAHSSSKGREAPGRPPRAVPKLGVPPSSPTHGPAPACRSGAAKAVGAPKPPVGGGKGRGLVAGGSRALGPSVKLSTASVTGRSPGGPVAGPRAAPRAGPSVGAKAGRGTVMGTKQALRAAHSRVHELSASGAPGRGGSSWGSADSDSGHDSGVNVGEERPPTGPALPSPYSKVTAPRRPQRYSSGHGSDNSSVLSGELPPAMGRTALFHHSGGSSGYESLRRDSEATGSASSAPDSMSESGAASPGARTRSLKSPKKRATGLQRRRLIPAPLPDTTALGRKPSLPGQWVDLPPPLAGSLKEPFEIKVYEIDDVERLQRPRPTPREAPTQGLACVSTRLRLAERRQQRLREVQAKHKHLCEELAETQGRLMLEPGRWLEQFEVDPELEPESAEYLAALERATAALEQCVNLCKAHVMMVTCFDISVAASAAIPGPQEVDV

SEQ ID NO: 777838 - protein, 1413 aa, Homo sapiens
QVILYDPAAGPPGSAGPRRAATAAVPKMFAFDAVFPQDSEQAEVCSGTVADVLQSVVSGADGCIFSFGHMSLGKSYTMIGKDSSPQSLGIVPCAISWLFRLIEERRERTGTRFSVRVSAVEVCGRDQSLRDLLAEVAPGSLQDTQSPGVYLREDPVCGAQLQNQSELRAPTAEKAAFYLDAALAARSTSRAGCGEDARRSSHMLFTLHVYQYRMEKCGRGGMSGGRSRLHLIDLGSCEAAAGRAGEAAGGPLCLSLSALGSVILALVNGAKHVPYRDHRLTMLLRESLATAGCRTTMIAHVSDAPAQHAETLSTVQLAARIHRLRRKKAKYASSSSGGESSCEEGRARRPPHLRPFHPRTVALDPDRTPPCLPGDPDYSSSSEQSCDTVIYVGPGGAALSDRELTDNEGPPDFVPIIPALSRHRPSKGPRDADHFRCSTFAELQERLECMDGNEGPSGGPGGTDGAQASPARGGRKPSPPEAASPRKAVGTPMAASTPRGSSGPDTHQGTPEPCKAIVWGDQREDSSAWPELLVPEKAAVSGGRRPLPSPAPPPPQLLEACRAPEEPGGGGTDGVARTPPVGMSGQVAGSPMLPGATCPRLAAGSRCPERGLLTTTVTLQRPVELNGEDELVFTVVEELSLGALAGAGRPTSLASFDSDCSLRALASGSRPVSIISSINDEFDAYTSQAPEGGPLEGAAWAGSSHGSSISSWLSEVSVCTADSRDPTPQPRFSPDSLAGLDPGGPPALDGSLGDGSSGFLGPDRPDSPGPTWGPCPGEVAAVAPSRPGREPQAGPSRWASAAQTIHSSLPRKPRTASATTRVGCARLGQSPPGRGGLFEDPWLLRVGECDTQAASAGRAPSPTLGSPRLPEAQVMLACAQRVVDGCEVAARAARRPEAVARIPPLRRGATTLGVTTPAVSWGDAPTEVVACSGSLKASPTSKKGLAPKAGFLPRPSGAAPPAPPTRKSSLEQRSSPASAPPHAVNPARVGAAAVLRGEEEPRPSSRADHSVPRATSSLKARASKVEAAHRLAGHASLERYEGLAHSSSKGREAPGRPPRAVPKLGVPPSSPTHGPAPACRSGAAKAVGAPKPPVGGGKGRGLVAGGSRALGPSVKLSTASVTGRSPGGPVAGPRAAPRAGPSVGAKAGRGTVMGTKQALRAAHSRVHELSASGAPGRGGSSWGSADSDSGHDSGVNVGEERPPTGPALPSPYSKVTAPRRPQRYSSGHGSDNSSVLSGELPPAMGRTALFHHSGGSSGYESLRRDSEATGSASSAPDSMSESGAASPGARTRSLKSPKKRATGLQRRRLIPAPLPDTTALGRKPSLPGQWVDLPPPLAGSLKEPFEIKVYEIDDVERLQRPRPTPREAPTQGLACVSTRLRLAERRQQRLRGVSLPAFATSPHDRLILSEDRA

SEQ ID NO: 777839 - protein, 96 aa, Homo sapiens
CAWAGPRLCSPCARLSVPGLQRRRLIPAPLPDTTALGRKPSLPGQWVDLPPPLAGSLKEPFEIKVYEIDDVERLQRPRPTPREAPTQVGPLVGWGL

SEQ ID NO: 777840 - protein, 227 aa, Homo sapiens
GSPPREVLRRAAGARRARRAPLGLPGGGPGRPLSAAAAAPAAFCVAGQGPGPHIASPGNAGALEPGSRGDRREGSSPGWRSSGAAPSPGNQPSPPQESAGVDAPARSFLVLPVALQFREESQRRRGPQRRLVFLAHTLPPHRVLLFLPGCFLSSPGKRIWRNRFRDCHPTGKGPASWKGGRGGTGAPSELLLEAVARPGNVVTSAGRLRPTPALPPGPRGSQREPQL

SEQ ID NO: 777841 - protein, 117 aa, Homo sapiens
AFIGHIGTAAVSTERERERERNRVWKLFSKSWEMQSHRRMTGPSSNPNEITSKYLGAFQLLLVELDKSDLRQVILSVFLKVRLHCISCPISWQWKRGQLFLVLGELEKQRICHLGVG

SEQ ID NO: 777842 - protein, 114 aa, Homo sapiens
VIIPQLKLEGTLSVPGPSFADTEVRCSSLEATHSVHIINNTSYSKDGTFLPSTHTANSTVNTDSQHAGPSLITQKMHAINSDSKKSSTKSNSRPGTVAHTCKPSILKGRGGLIA

SEQ ID NO: 777843 - protein, 128 aa, Homo sapiens
LIWFEPLFLPNLMLKCNSQHWRQSLAGDVCIMGVNGSVTSPWCILKCVAPAPLTLSLLLPLLPCEMPAPPSPSTMIGSFLRSHQEQMPVLCFLYSLQNCEPIKPLFFTNYPASGIPLQQCKNRLIQCP

SEQ ID NO: 777844 - protein, 203 aa, Homo sapiens
MSKSESPEEPEQLRKLFIGGLSFETTDESLRSHFEQWGMLTDCVVMRDPNTKHPRGFGFVTYATVEEVDAAMNARPHKVDGRVVEPKRAVSREDSERPGAHLTVKKIFVGGIKEDTEEHHLRDDFEQYGKIEVIEIMTDRGSGKKRGFAFVNFDDHDSMDKIVIQKYHTVNGHNCEVRKAPSQQEMDSASSSQRGRSGSGNFG

SEQ ID NO: 777845 - protein, 81 aa, Homo sapiens
VAVLIQCAGLDGRPDELLHKLPAGILNEHLFGPKLQCLLPGFLEVFLLASVGQVGNDVIALFLQPHEDARGVRAATVGQNH

SEQ ID NO: 777846 - protein, 647 aa, Homo sapiens
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 777847 - protein, 357 aa, Homo sapiens
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYVFLSGFLLKRL

SEQ ID NO: 777848 - protein, 313 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777849 - protein, 352 aa, Homo sapiens
MRPWGSPYSSGQPTSAATGAGHAPGPWSCLEVQCWGSRAMSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777850 - protein, 161 aa, Homo sapiens
GALEDLNRTNKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSLSWRLNPL

SEQ ID NO: 777851 - protein, 1385 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 777852 - protein, 1751 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKVIGASGKIEMGTKDTHGPKGVTPTESLQERENKVRGGHLSSLHWRFGGSKERGDGFVPHNSWGCHSHSVIYLMPPAVCNSAAQLVIPRGLMEKYCGAAFLTASIIRIQEIYSLDKLLGVPSIDSILNQIETSLILFLRDLFALTSYLYPWLLFSRPVRYYSELTTALISQQKVCVWGQEGFPNISFIATVLGQGQETKASVVCDDDFGITASFLLPFLSSPGSSQLLLGILCEMICDWSTISQIHFVYEFYTVADCSHTVKLEHSYSYLNKNVKKACDSFFDYVSNILTGMAPGMHAAIHVVMVTRTDNQNKYAGPLAVKGSDFNFGVTVFIVGRVCLSKYVFPDSLGHPWNVFCPVSPLPFLEPQIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 777853 - protein, 1529 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGCLEVQCWGSRAMSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777854 - protein, 313 aa, Homo sapiens; identical to SEQ ID NO: 777848

SEQ ID NO: 777855 - protein, 345 aa, Homo sapiens
GKWAHCQSRLPASSPFFLLCSCLEVQCWGSRAMSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777856 - protein, 313 aa, Homo sapiens; identical to SEQ ID NO: 777848

SEQ ID NO: 777857 - protein, 1529 aa, Homo sapiens; identical to SEQ ID NO: 777853

SEQ ID NO: 777858 - protein, 1529 aa, Homo sapiens; identical to SEQ ID NO: 777853

SEQ ID NO: 777859 - protein, 133 aa, Homo sapiens
MCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777860 - protein, 1202 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKESSASPRAAV

SEQ ID NO: 777861 - protein, 125 aa, Homo sapiens
RPPPRPVPPPARRSRFSPLFSYKTPHCSGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777862 - protein, 1385 aa, Homo sapiens; identical to SEQ ID NO: 777851

SEQ ID NO: 777863 - protein, 313 aa, Homo sapiens; identical to SEQ ID NO: 777848

SEQ ID NO: 777864 - protein, 474 aa, Homo sapiens
RIGVTQRAAAEVRAGPEERHTHWGVGLGLPLSALARPQDSPCPLRDPRGPGRSLHLVLPTAGLGQVRGPGCDLGAAPTLPGSPLPRPPVQGMPRGRGGEGKRRESRFNSAPVPQGRASQPGLQTLASFKLQTCVGLREEVGEEKGSEYNSCLEVQCWGSRAMSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777865 - protein, 316 aa, Homo sapiens
VVKVLPLVFLSAVQLLGASALSPVAIETWAGQCLLPSGVPLLHCAHGQRPCPAARGWLERAVRWLGCAQCSCNRTLSRCADRRPQRAAAEPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777866 - protein, 390 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVLLYILQLLEMKSDLALPSVKLCVADMSAPHEVILQQGHVCLSVHMNFELEVHGEAAIESAAGGSREGVDFMLVPSHVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 777867 - protein, 1202 aa, Homo sapiens; identical to SEQ ID NO: 777860

SEQ ID NO: 777868 - protein, 1110 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYAETWQNPIST

SEQ ID NO: 777869 - protein, 1011 aa, Homo sapiens
AAIGATNGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSLSWRLNPL

SEQ ID NO: 777870 - protein, 1246 aa, Homo sapiens
GSESWNPAGVALSAGCEEGGSGQAIAMAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWVVYHELVLTTKEYMREVTTIDPRWLVEFAPAFFKVSDPTKLSKQKKQQRLEPLYNRYEEPNAWRISRAFRRR

SEQ ID NO: 777871 - protein, 1252 aa, Homo sapiens
GSESWNPAGVALSAGCEEGGSGQAIAMAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRCLLIFRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWVVYHELVLTTKEYMREVTTIDPRWLVEFAPAFFKVSDPTKLSKQKKQQRLEPLYNRYEEPNAWRISRAFRRR

SEQ ID NO: 777872 - protein, 597 aa, Homo sapiens
MSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWVVYHELVLTTKEYMREVTTIDPRWLVEFAPAFFKVSDPTKLSKQKKQQRLEPLYNRYEEPNAWRISRAFRRR

SEQ ID NO: 777873 - protein, 582 aa, Homo sapiens
LFLATVPTRARVSVSPRGPRCLRRSLCRAVTCTGRGSRREDAGTPGSREMDSVAFEDVAVNFTLEEWALLDPSQKNLYRDVMRETFRNLASVGKQWEDQNIEDPFKIPRRNISHIPERLCESKEGGQGEETFSQIPDGILNKKTPGVKPCESSVCGEVGMGPSSLNRHIRDHTGREPNEYQEYGTKSYTRNQCGRALSYHRSFQYVKGLILEGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPKLQLSQFFHEHKRSHIEKPHESKKFGKAFSPFCFFQLRERIHSGERPCKIIGFKLRETCDRTVKPRVGVGSLDCVMSVLVG

SEQ ID NO: 777874 - protein, 39 aa, Homo sapiens
MALTRMMPRADTALPGPEAKADNGTRGRRKKWGAPKPSS

SEQ ID NO: 777875 - protein, 121 aa, Homo sapiens [sequence omitted]

SEQ ID NO: 777876 - protein, 54 aa, Homo sapiens
LTGSGVQSSSSAVHSIMLYPRALVRDIKRLSLPLNNLKPNYTDNHNNDLDLKSR

SEQ ID NO: 777877 - protein, 195 aa, Homo sapiens
MINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLALLLIHPSEGVCSSLECKEPRL

SEQ ID NO: 777878 - protein, 132 aa, Homo sapiens
MINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVKCGCRDYGKIQYN

SEQ ID NO: 777879 - protein, 124 aa, Homo sapiens
GRTCTAWGACHSTASWLRYARDSPLGARQTSKPVGWPPASCEGAGIGAWKMSSDLPKVMQTTPDGCLVNWKLAEPPDSSVSSWLHHAVSSVQSSTEQSLGSPLSGFRSQLRSPAARWEQGPVDL

SEQ ID NO: 777880 - protein, 96 aa, Homo sapiens
PDYSPKALHDPAPFTAPGSLPTSCSQPTDHRLPHAPSPRISSTSASWLFLELPEFTPVSRTFLCFSLDRRHPSQFTWLTRFIQVSSPVSPPCDPWI

SEQ ID NO: 777881 - protein, 104 aa, Homo sapiens
LKYKIFFLILSKAKYFYRKVCPYRWSNDGVSLCQSDWSAVARSQLTATSASRVQEILSSSWYYRGPGQCQHQEPHMRWRGQWTCSSTWCCTSGRSCSLHHCSPS

SEQ ID NO: 777882 - protein, 66 aa, Homo sapiens
KEAKKAAKVQKLSKNEVLMVNIGSLSTGGRVSAVKADLGKIVLTNPVCTEVGEKIALSRRVEKHWR

SEQ ID NO: 777883 - protein, 472 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 777884 - protein, 472 aa, Homo sapiens; identical to SEQ ID NO: 777883

SEQ ID NO: 777885 - protein, 472 aa, Homo sapiens; identical to SEQ ID NO: 777883

SEQ ID NO: 777886 - protein, 472 aa, Homo sapiens; identical to SEQ ID NO: 777883

SEQ ID NO: 777887 - protein, 472 aa, Homo sapiens; identical to SEQ ID NO: 777883

SEQ ID NO: 777888 - protein, 472 aa, Homo sapiens; identical to SEQ ID NO: 777883

SEQ ID NO: 777889 - protein, 472 aa, Homo sapiens; identical to SEQ ID NO: 777883

SEQ ID NO: 777890 - protein, 472 aa, Homo sapiens; identical to SEQ ID NO: 777883

SEQ ID NO: 777891 - protein, 472 aa, Homo sapiens; identical to SEQ ID NO: 777883

SEQ ID NO: 777892 - protein, 472 aa, Homo sapiens; identical to SEQ ID NO: 777883

SEQ ID NO: 777893 - protein, 472 aa, Homo sapiens; identical to SEQ ID NO: 777883

SEQ ID NO: 777894 - protein, 452 aa, Homo sapiens [sequence omitted]

SEQ ID NO: 777895 - protein, 143 aa, Homo sapiens
LLIICLQVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLV

SEQ ID NO: 777896 - protein, 262 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRIYLNPVCVDFVSQR

SEQ ID NO: 777897 - protein, 183 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIGKYLTIGLDKSMWNKSKMKYLKGN

SEQ ID NO: 777898 - protein, 114 aa, Homo sapiens [sequence omitted]

SEQ ID NO: 777899 - protein, 106 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKLDERITRIDGDMARRTFSA

SEQ ID NO: 777900 - protein, 472 aa, Homo sapiens; identical to SEQ ID NO: 777883

SEQ ID NO: 777901 - protein, 472 aa, Homo sapiens; identical to SEQ ID NO: 777883

SEQ ID NO: 777902 - protein, 412 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKFNWLGSDKKRSDNQANSR

SEQ ID NO: 777903 - protein, 452 aa, Homo sapiens [sequence omitted]

SEQ ID NO: 777904 - protein, 309 aa, Homo sapiens
GRRGSTHASHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 777905 - protein, 163 aa, Homo sapiens
MCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 777906 - protein, 245 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGRGLQIHFSVMGKDSRLLVEYNRCTGRQLWRTM

SEQ ID NO: 777907 - protein, 166 aa, Homo sapiens
MAGGEAGVTLGQPHLSRQDLTTLDVTKLTPLSHEVISRQATINIGTIGHVAHGKSTVVKAISGVHTVRFKHMTLSTQHNHSPHQALGSCSMLKHLSQLACTQRLPLGPSTCSSASLVEQPDHHHGTAAFPHGTIHRGHLNRGTLSTHIHDPDTHVLSLSRYDTMVA

SEQ ID NO: 777908 - protein, 294 aa, Homo sapiens
MAPWKKGFSKNQYGCGGEGAPRRVNRPTVWTHIRRASPQGKNTGEQEPTDGAGELSTHSNDKKQRHAAKQTPRKAFLPDSNKSQHIRTNYTRKESHQQPAANSLKQQDKRSSAPQKAEKRSKQDNEKEMDTTQPHEQTGGAQTERERRENTTKQKTNNRQNTREQKTQQNHEKTNKKHKPTVEQERAAGRKEDRGAERKQARETRDTREKEEGSASHGKENETERKDRKGRERNEKERRKRERTKEARHEENRQQKEKREASEERSYERRKKHEARTKNDREARRESKGERQCT

SEQ ID NO: 777909 - protein, 79 aa, Homo sapiens
WAEGQQPPCWGQGFVLIEESKAIHSFIHSSTYPPWSGHLCCAWPPVPGLLGTDPAVWTRLWPWEPCAQPPGTQLLSIEV

SEQ ID NO: 777910 - protein, 127 aa, Homo sapiens
PGSSDSAAPAFQEAEITGAHQARLIFIFLVGEQSGSGLHFPEDSAGQYHVSRDFGFLLARWQNLSLCPISCCHALESGVTWPGRPRAELEKAEDEESGSGPFVCGGLRRGVCVCDCDGCRGSSWSVT

SEQ ID NO: 777911 - protein, 228 aa, Homo sapiens
ACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQI

SEQ ID NO: 777912 - protein, 450 aa, Homo sapiens
QFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPSVPKTSASRTQKSAVEHKAKKSLSHPSHSRPGPMVTPHNKAKSPGVRQPGSSSSSAPGQPSTGVARPTVSSGPVPRRQNGSSSSGPERSISGSKKPTNDSNPSRRTVSGTCGPGQPASSSGGPGRPISGSVSSARPLGSSRGPGGPVSSPHELRRPVSGLGPPGRSVSGPGRSISGSIPAGRTVSNSVPGRPVSSLGPGQTVSSSGPTIKPKCTVVSETISSKNIISRSSNGQMNGMKPPLSGYRAAQGPQRLPFPTGYKRQREYEEEDDDDDEYDSEMEDFIEDEGEPQEEISKHIREIFGYDRKK

SEQ ID NO: 777913 - protein, 170 aa, Homo sapiens
LFLWPTLLHRPAARPRLWGARRGSKQMMQWHKERACAPEPTSQTPPASPLSKLSRPYLVELLSRRAGRPDPEPSEPSKEDQESSDRRPPSPPGPEERKGQKRDEEEEATERKPASPPLPATQQEKPSQTPEAGRKTSSAQHQRHHRNSSARSTHPAPATPSSWPPPAVDG

SEQ ID NO: 777914 - protein, 163 aa, Homo sapiens
LFLWPTLLHRPAARPRLWGARRGSKQMMQWHKERACAPEPTSQTPPASPLSKLSRPYLVELLSRRAGRPDPEPSEPSKEDQESSDRRPPSPPGPEERKGQKRDEEEEATERKPASPPLPATQQEKPSQTPEAGRKEADASEQTLLRWLQTYRESGNCSRAAGN

SEQ ID NO: 777915 - protein, 48 aa, Homo sapiens
MLCPDWTPWCLSIILSRVTFPCTVTLRSFKQWFPKVTEQVVVWCVCVC

SEQ ID NO: 777916 - protein, 175 aa, Homo sapiens
PSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTY

SEQ ID NO: 777917 - protein, 118 aa, Homo sapiens
DVSMAAAPDYPAPFYPSSGRNPSPRPFPLKGNGPKVGRAARLPRSIQVKRESDQTGEPRGPIFRDLTGHLDRPLQLGTFQENEGNVVIAPEPHSSSEVLFTSLWKKIGYLFLVERVEI

SEQ ID NO: 777918 - protein, 46 aa, Homo sapiens
HHLRTSVPDPLEKNLYFNKIPRWFAYTLSVSHAASELLPEEWLSDQ

SEQ ID NO: 777919 - protein, 280 aa, Homo sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 777920 - protein, 280 aa, Homo sapiens; identical to SEQ ID NO: 777919

SEQ ID NO: 777921 - protein, 280 aa, Homo sapiens; identical to SEQ ID NO: 777919

SEQ ID NO: 777922 - protein, 280 aa, Homo sapiens; identical to SEQ ID NO: 777919

SEQ ID NO: 777923 - protein, 107 aa, Homo sapiens
MPADIMEKNSSSPVAATPASVNTTPDKPKTASEHRKSSKPIMEKRRRARINESLSQLIFWFSKTALLIIFQYTELFYSFYIVNMTVVLYLLNIGVGLKYNKSVPYQK

SEQ ID NO: 777924 - protein, 414 aa, Homo sapiens
MPADIMEKNSSSPVAATPASVNTTPDKPKTASEHRKSSKPIMEKRRRARINESLSQLKTLILDALKKDKLEKADILEMTVKHLRNLQRAQMTAALSTDPSVLGKYRAGFSECMNEVTRFLSTGNAARSFNEKTNTFSATKSETPRPAGSGTRWYCVLPGGRARPYSLGSRDNACAPWPGGGTPSTLKQLTRGSLSFLAYSMQSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 777925 - protein, 123 aa, Homo sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTGEGGSPRPPVRASRSPRGDFFQTSAR

SEQ ID NO: 777926 - protein, 257 aa, Homo sapiens
MPADIMEKNSSSPVAATPASVNTTPDKPKTASEHRKSSKPIMEKRRRARINESLSQLKTLILDALKKDKLEKADILEMTVKHLRNLQRAQMTAALSTDPSVLGKYRAGFSECMNEVTRFLSTGNAARSFNEKTNTFSATKSETPRPAGSGTRWYCVLPGGRARPYSLGSRDNACAPWPGGGTPSTLKQLTRGSLSFLAYSMQSSRHSKLEKADILEMTVKHLRNLQRAQMTGEGGSPRPPVRASRSPRGDFFQTSAR

SEQ ID NO: 777927 - protein, 558 aa, Homo sapiens
GTGGLSVYKPRPFRSLGLPRAPSVVMAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISSCPGLLYLNLESCRCLPRGLKRAYRGLEEVQWCLEQLLTSPSPS

SEQ ID NO: 777928 - protein, 564 aa, Homo sapiens
GTGGLSVYKPRPFRSLGLPRAPSVVMAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQVHPVLKLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISSCPGLLYLNLESCRCLPRGLKRAYRGLEEVQWCLEQLLTSPSPS

SEQ ID NO: 777929 - protein, 300 aa, Homo sapiens
MLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISSCPGLLYLNLESCRCLPRGLKRAYRGLEEVQWCLEQLLTSPSPS

SEQ ID NO: 777930 - protein, 660 aa, Homo sapiens
GTGGLSVYKPRPFRSLGLPRAPSVVMAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQVHPVLKLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVRSASPTPVPGASVAVTVSAWAWKLCPAWPETSRGQRGMHTVQAPAWGGPEDTRGTGLGLGGYGWQSQVSNTSRHSSLAWPSPSEATAQLPVVCPPHSSVISSCPGLLYLNLESCRCLPRGLKRAYRGLEEVQWCLEQLLTSPSPS

SEQ ID NO: 777931 - protein, 300 aa, Homo sapiens; identical to SEQ ID NO: 777929

SEQ ID NO: 777932 - protein, 435 aa, Homo sapiens
GTGGLSVYKPRPFRSLGLPRAPSVVMAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQVHPVLKLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRAL

SEQ ID NO: 777933 - protein, 103 aa, Homo sapiens
MLAKACCQLHSLDLQHSMVESTAVVSFLEEAGSRMRKLWLTYSSQTTAILGALLGSCCPQLQVLEVSTGINRNSIPLQLPVEALQKGCPQLQVPGALPLPPVT

SEQ ID NO: 777934 - protein, 130 aa, Homo sapiens
LPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLP

SEQ ID NO: 777935 - protein, 117 aa, Homo sapiens
MDSSGPSAISPASLTEDGEFQTKLILPPGKPAPSAVIDGLRSSALGLNPKQEEEAGVLRCPSGRPGAASNCLCVWDLTGEGVPKPSISPSWPMDSGFPRRGKCARATGKAELCGPAS

SEQ ID NO: 777936 - protein, 67 aa, Homo sapiens
AIAAMLCCGEFPPVQTTQTPLSWQAKMADSSHGNGGCPSLQELSHLRQSPVSCRWPGWNSKSVDLIL

SEQ ID NO: 777937 - protein, 71 aa, Homo sapiens
HGALQYTKAETQSPQVERGSLDGISYLQSSWVPIEPPTFCLSQIGVTIFILSDFRPPSESDVRSSPIEERK

SEQ ID NO: 777938 - protein, 118 aa, Homo sapiens
PGTRCIPVFPAGPSESSLSASGNLAPLTPLASAQPWCTCENCPPRPGGESPGVQRLCTAPSGLAVSTQNIFRSCLGGSCPLASVFLFHIRACGACILSASPNLLVGSSPNSLCTLKFI

SEQ ID NO: 777939 - protein, 141 aa, Homo sapiens
AYDQLTLTVTNFFKQEGDRLSDEDLYKFLADMRRPSSVLRRLRPITAQLKIDISPAPENPHYCLTPELLQVKLYPDSRVRPTREILEFPARWFMFQTLLTEIFSTYTLRVLILPIVKVLLGNITVKVQFMYGRGSKAMPCR

SEQ ID NO: 777940 - protein, 189 aa, Homo sapiens [sequence omitted]

SEQ ID NO: 777941 - protein, 112 aa, Homo sapiens
LSLASVTFTQNTMGTPCPFAAGFLCHSFGMGVENAHPQPLEPGVGGKAILSCTYPPLSRSRAGWVQTPTSSTSHAVSFLHTVAHRLSLGTREEFSNHLAEEIPPVPWTTTRT

SEQ ID NO: 777942 - protein, 175 aa, Homo sapiens
MSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 777943 - protein, 218 aa, Homo sapiens
HCSGQGLGQGDYADAGSTRAEWTKRGRGIIGIFRGNPYWALGRFVACHARSREMAAVASRVTAPLYYLLTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 777944 - protein, 95 aa, Homo sapiens
DATLEAMSALGDPVLLAPTNYTKGHMSQIPFLKNTKKIKCHQMAGEGGAGYKIRVCPKASQCCWSLSDESSLQKNKKEADVQGEEEIRDCESPEK

SEQ ID NO: 777945 - protein, 131 aa, Homo sapiens
GPQLCQHMACRLLSNGCLKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 777946 - protein, 135 aa, Homo sapiens
GPQLCQHMACRLLSNGCLKIEAIKLAEQKHREERRRRATVVVGDLHPLRDALPELLGLEAGSRRQARRGRKDPVSGAAGQSGLQSQPPGGHRADAGPADAAGRWRPALTRAAGMPQLLRTHVGQVESAGPSRTMA

SEQ ID NO: 777947 - protein, 85 aa, Homo sapiens
MPLRVLEEPGEPLRGQFVSLEPPMWAQGGRLGLGLDPSWGKVQVCAMQLLAQVGPLWAGSCPGARGMDTGASSHGKLISFHFYTE

SEQ ID NO: 777948 - protein, 68 aa, Homo sapiens
AADDSQRIPPALIFGMNTICHLIFPQRKSKARQYVKRPAQEQGKFSPPRNLLSPERSLFCGKNRGFEE

SEQ ID NO: 777949 - protein, 227 aa, Homo sapiens
LCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQKFSMDVVCLPICFMFNSFISVIEEMLNRLESEHKTKLEQLHIMQEQQKSLDIGNQMNVSEEMKVTNIGNQQIDKVFNNIGADLLTGSESENKEDGLQNKHKRVSFL

SEQ ID NO: 777950 - protein, 36 aa, Homo sapiens
MLSLRCREHPGRVNGIKRDMCTGSEGFTAIGGSEHK

SEQ ID NO: 777951 - protein, 118 aa, Homo sapiens
MHGKDLGKWHSDWENSISRGTEVGEFRVQGRAKTVTNNFNPLHTGVSKKENVSVGLASGAAGSRASKTHQDSASSSQLSLLFLLGTGWSPAAPDRLPSSFTSLKKRAPLSHGSNRNPG

SEQ ID NO: 777952 - protein, 94 aa, Homo sapiens
MRTPVGLAGGPAWEVPHWAGPQDLHTRENSNLCQPQNTGGGGCRPPLGGPSLGRTPIPRCQGELKSLSAPEYWRGWGELAGGLSWKDPHWAGTG

SEQ ID NO: 777953 - protein, 214 aa, Homo sapiens
GILLMEVLVLAVKQLFPEFEFMWLVDEAKKNLPLELDFLNEGRNAEKVSQMLRHFDFLKVPRIHWDLSTERVLLMEFADGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATE

SEQ ID NO: 777954 - protein, 109 aa, Homo sapiens
VFCSDGSHYVAQAGLVLLGSFIPPTLASQSVGIAGVAIAPGLFPLFISSEWLSGDGDNEFQLSRKRLKTPTCPKSCVAVSRGSWSPYYCFQSTPMAHGSAWSVGSRPTS

SEQ ID NO: 777955 - protein, 120 aa, Homo sapiens
HLGLSGDTAVPAPGPHGPDSACPPLVGRAAFWFLCAPSFCPSPDLCPCCFLCLTVPPTCTCACTHTHTHVSHTWPGRIECIWVASNRNRPWLIEGGITKDDSPSRRLLILMWDDEVNMAG

SEQ ID NO: 777956 - protein, 117 aa, Homo sapiens
MSPSHTPAVGSGELSTGAASLWRRDPLPSLRRTLAANTSGYEPGARPGCLCHPLSPAQGRQVTPTPGCASIHSAGEAGDRHFWSPLPGVHLCCALRGLGGLGQRCSSYSASVSSPVK

SEQ ID NO: 777957 - protein, 118 aa, Homo sapiens
MPSFPLLFMTAMGTPSCWSSILRNSFTGTPSRFCCQVHGEDVMIGPTRSVGKFWRLFCLRKCNSKVMIDPRKFKASGIKAVMFPEFGGHITISINFALNGLSSLSHAYDVFFCNIIPH

SEQ ID NO: 777958 - protein, 120 aa, Homo sapiens
ARNNIVRIFKLGWSGQGPGACLAFSPGSSPANPANRALTSSSWVGMNPRSIQSAFLGTSNHSNINNNKNNNRSYHLFLNMPAVILVTLHAFPHLIFTIALQNAGCYYFHFENEETEAQRG

SEQ ID NO: 777959 - protein, 487 aa, Homo sapiens
MASLVAYDDSDSEAETEHAGSFNATGQQKDTSGVARPPGQDFASGTLDVPKAGAQPTKHGSCEDPGGYRLPLAQLGRSDRGSCPSQRLQWPGKEPQVTFPIKEPSCSSLWTSHVPASHMPLAAARFKQVKLSRNFPKSSFRAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKEPSYLVVEVTLESLPVKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 777960 - protein, 543 aa, Homo sapiens
MTARTLSLMASLVAYDDSDSEAETEHAGSFNATGQQKDTSGVARPPGQDFASGTLDVPKAGAQPTKHGSCEDPGGYRLPLAQLGRSDRGSCPSQRLQWPGKEPQVTFPIKEPSCSSLWTSHVPASHMPLAAARFKQVKLSRNFPKSSFRAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKVERRGLRALPADLLPAHRGSAGRRWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 777961 - protein, 543 aa, Homo sapiens; identical to SEQ ID NO: 777960

SEQ ID NO: 777962 - protein, 92 aa, Homo sapiens
GDNLLARYEAWVVSFLRAKVKDPLCEGSAEVGSHAPSRPLPALHSGRNLSFPCEKGQRVQASQVQREGPQPLLAAKHADPMDIWGKGSLGCW

SEQ ID NO: 777963 - protein, 146 aa, Homo sapiens
MTDTPGESWAKASWPVSLSSTAGGLGGVCRGVPGAPGVRVCRGLQGVQGLGELSNFLELIPGTHFQRPHRLTAEPCLVYMGRVEGAWGTESCVSPEGGKTCRGTGRKRCGRADGMGTSSTATLPLARVLATPHKTSTHHTQAQRGR

SEQ ID NO: 777964 - protein, 79 aa, Homo sapiens
MEPPGGAYLHLGAVTSPVCTARVLQLAFGCTTFSLVAHRGGFAGVQGTFCMDAWGFCFAVSALVVACEFTRLHGCLRLS

SEQ ID NO: 777965 - protein, 79 aa, Homo sapiens; identical to SEQ ID NO: 777964

SEQ ID NO: 777966 - protein, 319 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 777967 - protein, 380 aa, Homo sapiens
DGGGAWVRVPRGGRSAEGWVRPAHGSWVGVGLREWWAAVAGWGATSRCHLWGLWARGSPDSMSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 777968 - protein, 319 aa, Homo sapiens; identical to SEQ ID NO: 777966

SEQ ID NO: 777969 - protein, 319 aa, Homo sapiens; identical to SEQ ID NO: 777966

SEQ ID NO: 777970 - protein, 319 aa, Homo sapiens; identical to SEQ ID NO: 777966

SEQ ID NO: 777971 - protein, 319 aa, Homo sapiens; identical to SEQ ID NO: 777966

SEQ ID NO: 777972 - protein, 319 aa, Homo sapiens; identical to SEQ ID NO: 777966

SEQ ID NO: 777973 - protein, 319 aa, Homo sapiens; identical to SEQ ID NO: 777966

SEQ ID NO: 777974 - protein, 319 aa, Homo sapiens; identical to SEQ ID NO: 777966

SEQ ID NO: 777975 - protein, 289 aa, Homo sapiens
MASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 777976 - protein, 217 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAVHG

SEQ ID NO: 777977 - protein, 217 aa, Homo sapiens; identical to SEQ ID NO: 777976

SEQ ID NO: 777978 - protein, 288 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 777979 - protein, 288 aa, Homo sapiens; identical to SEQ ID NO: 777978

SEQ ID NO: 777980 - protein, 395 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKMSGPPSSRAREPGGSSPTPTPVSAGTGSFLRAKVKDPLCEGSAEVGSHAPSRPLPALHSGRNLSFPCEKGQRVQASQVQREGPQPLLAAKHADPMDIWGKGSLGCW

SEQ ID NO: 777981 - protein, 186 aa, Homo sapiens [sequence omitted]

SEQ ID NO: 777982 - protein, 104 aa, Homo sapiens [sequence omitted]

SEQ ID NO: 777983 - protein, 106 aa, Homo sapiens
MSGPPSSRAREPGGSSPTPTPVSAGTGSFLRAKVKDPLCEGSAEVGSHAPSRPLPALHSGRNLSFPCEKGQRVQASQVQREGPQPLLAAKHADPMDIWGKGSLGCW

SEQ ID NO: 777984 - protein, 319 aa, Homo sapiens; identical to SEQ ID NO: 777966

SEQ ID NO: 777985 - protein, 319 aa, Homo sapiens; identical to SEQ ID NO: 777966

SEQ ID NO: 777986 - protein, 319 aa, Homo sapiens; identical to SEQ ID NO: 777966

SEQ ID NO: 777987 - protein, 319 aa, Homo sapiens; identical to SEQ ID NO: 777966

SEQ ID NO: 777988 - protein, 319 aa, Homo sapiens; identical to SEQ ID NO: 777966

SEQ ID NO: 777989 - protein, 319 aa, Homo sapiens; identical to SEQ ID NO: 777966

SEQ ID NO: 777990 - protein, 319 aa, Homo sapiens; identical to SEQ ID NO: 777966

SEQ ID NO: 777991 - protein, 319 aa, Homo sapiens; identical to SEQ ID NO: 777966

SEQ ID NO: 777992 - protein, 217 aa, Homo sapiens; identical to SEQ ID NO: 777976

SEQ ID NO: 777993 - protein, 217 aa, Homo sapiens; identical to SEQ ID NO: 777976

SEQ ID NO: 777994 - protein, 199 aa, Homo sapiens [sequence omitted]

SEQ ID NO: 777995 - protein, 336 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRGGPPRCPLPWSPVLAWQRPLSHTSAHSRTQQIRIELQPSVAQDTGGPEVPWVTVGSAPPHLPFPARREHP

SEQ ID NO: 777996 - protein, 174 aa, Homo sapiens
MGRGEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 777997 - protein, 226 aa, Homo sapiens
TGAGPGCGCRVAAAALRGGYDPRTSRCHLWGLWARGSPDSMSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYGAAVHG

SEQ ID NO: 777998 - protein, 192 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYPGPSGQGLTRPA

SEQ ID NO: 777999 - protein, 106 aa, Homo sapiens; identical to SEQ ID NO: 777983

SEQ ID NO: 778000 - protein, 104 aa, Homo sapiens
MPQSPPTSPSQHLDLVSTSPSLAWNSCWGHKAYFFCFLSYFLPMFHSLERTFLTKTKTVLYRHLDLADMSHVLQQNAHALEIWHIRASKTIKQLFSNFSVLKTD

SEQ ID NO: 778001 - protein, 164 aa, Homo sapiens
EAFPTGYEKATVVISSLLSDIIPRLAFPPLYSPITDRPLLVKSPKQFLRLLVFSELTVFLKHTSPSSATNLKRTGYFYHFPFSEFGLVLKMLQGTAHLSSCIDAPFIRPQSHSRHQTNLDCTPKTCHPYCLLSSHTPIHHYQLLINALLFFTLPVYTVSPSHHS

SEQ ID NO: 778002 - protein, 130 aa, Homo sapiens
VSSGSIGQALTQAGLKPVELSSFSVDSLQGAAVCPGSQLCGAMGGGSWTLEGKVGAKLNIASHIQGRNLDLVYGRRGGVCVCKYSSSLVEDALVGRGGRMGAVTLEAVVCSSGRGNGSGSRHREIKGNPS

SEQ ID NO: 778003 - protein, 49 aa, Homo sapiens
QLKEEKGVCFYGNLKCPSTSPVNYLCVQAAELDSCEERRVVLMGALERK

SEQ ID NO: 778004 - protein, 120 aa, Homo sapiens
MQGQGIPCCSTIRFGTPPPPGPTRGHQLCLEGDHNRLDRIHRLGPRQEEGRRPQTPRTPAAPPTRRSPPLGSILPPPDTHTPATSRLLTLGQALWRCRRSRLFLKSQDWKADSHRLLSST

SEQ ID NO: 778005 - protein, 266 aa, Homo sapiens
QHGKKQLDPLTIYGIRCHLFYKFGITESDWYRIKQSIDSKCRTAWRRKQRGQSLAVKSFSRRTPNSSSYCPSEPMMSTPPPARELLQPQPQPQALHYALANVQQVQIHQIGEDGQVQVIPQGHLHIAKVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQGAGAQWHQEPSPVRYGRP

SEQ ID NO: 778006 - protein, 101 aa, Homo sapiens
CAEKDVSREAERRKLISQCRAGLGGLSSSPARSWELSHCSPCPFLLKFPRMDSAPCTQENTGGRARWLTPVIPALWEAKKGGSRGQEIETILANTVKPRLY

SEQ ID NO: 778007 - protein, 184 aa, Homo sapiens
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVETSTRSAEF

SEQ ID NO: 778008 - protein, 110 aa, Homo sapiens
ITSFVPGKPLVLLTRKLIIVLSFEGKSRSVLHKEIMPQTVRNATLLKDEILASHLNQSCENCVNIEKEGQRNIKNGAYRVTVSYLHITEILLFRELQSKTINPVTPLIQS

SEQ ID NO: 778009 - protein, 86 aa, Homo sapiens
MQHPSLFMEEEAGAWGQRCPLGGGWLEPEPWPRAAPFMWASLDGYVHKLTPGPLPPPRGLTLIFQVDPSPQMLWAIRGGVRLSSES

SEQ ID NO: 778010 - protein, 262 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKKVWPL

SEQ ID NO: 778011 - protein, 114 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQ

SEQ ID NO: 778012 - protein, 519 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 778013 - protein, 519 aa, Homo sapiens; identical to SEQ ID NO: 778012

SEQ ID NO: 778014 - protein, 582 aa, Homo sapiens
GGHWVLRGRQRASRCPRRQALPDAGAGGSCGAPGDPWQGAYATATTLRGCRSGHSRSGRTPAGCGVSSAPDSEPCTCVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 778015 - protein, 525 aa, Homo sapiens
DSSGAQPEAGTHSHWLLDPQVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 778016 - protein, 209 aa, Homo sapiens [sequence omitted]

SEQ ID NO: 778017 - protein, 519 aa, Homo sapiens; identical to SEQ ID NO: 778012

SEQ ID NO: 778018 - protein, 514 aa, Homo sapiens [sequence omitted]

SEQ ID NO: 778019 - protein, 355 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPCEWNFAPPPPHPPLSQSRMSVALCNVNPGSTYFLDARTHAKPGDAVVTGEVP

SEQ ID NO: 778020 - protein, 258 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDKRPWQKDSTSQSFLR

SEQ ID NO: 778021 - protein, 141 aa, Homo sapiens
MQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 778022 - protein, 296 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDLQPRGSSRA

SEQ ID NO: 778023 - protein, 180 aa, Homo sapiens
AAARLIKQFGRLAPEIAPGEEESSGERRAQATGAERSREQPESAPDSARVLSRPQLARIPGVLLAPLHEEGAFAARPAGVRTGPLETALAAPWAGRGTRARRARLASAPGGEQWSRAAGSRSAGTRQGWGRPSPRGTTLLAPATTPLGTHSRVSKPSAPPYLSPAALRRVPLCGAKPREP

SEQ ID NO: 778024 - protein, 354 aa, Homo sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLEMKCKCHGVSGSCSIRTCWKGLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 778025 - protein, 354 aa, Homo sapiens; identical to SEQ ID NO: 778024

SEQ ID NO: 778026 - protein, 236 aa, Homo sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 778027 - protein, 354 aa, Homo sapiens; identical to SEQ ID NO: 778024

SEQ ID NO: 778028 - protein, 354 aa, Homo sapiens; identical to SEQ ID NO: 778024

SEQ ID NO: 778029 - protein, 354 aa, Homo sapiens; identical to SEQ ID NO: 778024

SEQ ID NO: 778030 - protein, 197 aa, Homo sapiens [sequence omitted]

SEQ ID NO: 778031 - protein, 197 aa, Homo sapiens [sequence omitted]

SEQ ID NO: 778032 - protein, 124 aa, Homo sapiens
MAEPGPEPGRAWRVLALCGVAVFLAAAAAGGALVAWNLAASAARGPRCPEPGANATAPPGDPPPGVDDLRRRLAEAAEREEALARQLDQAESIRHELEKALKACEGRQVGGPGRGGARESRMLR

SEQ ID NO: 778033 - protein, 784 aa, Homo sapiens
RKWRGSLSSPSSLRGRRLVTGQTSPRGTWCLYPGFCRSVACAMPCCSHRSCREDPGTSESREMDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 778034 - protein, 129 aa, Homo sapiens
RKWRGSLSSPSSLRGRRLVTGQTSPRGTWCLYPGFCRSVACAMPCCSHRSCREDPGTSESREMDPVAFEDVAVNFTQEEWTLLDISQKNLFREVMLETFRNLTSIGNGVTRTLNMSTKDSHCGAFTQVP

SEQ ID NO: 778035 - protein, 766 aa, Homo sapiens
RKWRGSLSSPSSLRGRRLVTGQTSPRGTWCLYPGFCRSVACAMPCCSHRSCREDPGTSESREMDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 778036 - protein, 754 aa, Homo sapiens
WSPQHPENFLGIESRPPVLSLSPIFLYTCEMFQDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 778037 - protein, 1186 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKGSPVVLYVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 778038 - protein, 726 aa, Homo sapiens
MVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 778039 - protein, 1179 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 778040 - protein, 915 aa, Homo sapiens
RQEAPRGPTTGVAIHSVFSVSGTPWSCAVTASHYWEGSLCRKERKHWKSERGQAQTWSCWSLLHSCGFLILPPLLYCHPGLVSAELLSLAVIFSSFQFPGWSQGTEGSLIIALGNEDALGEYSCTPYNSLGTAGPSPVTRVLLKAPPAFIERPKEEYFQEVGRELLIPCSAQGDPPPVVSWTKGSPVVLEVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 778041 - protein, 1179 aa, Homo sapiens; identical to SEQ ID NO: 778039

SEQ ID NO: 778042 - protein, 110 aa, Homo sapiens
MLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 778043 - protein, 205 aa, Homo sapiens
RCWLGVLVSGKVGTGHIINTIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 778044 - protein, 91 aa, Homo sapiens
PGPAPSSRRPLQVQNFLESASPGPAPPASQWPLSAQPSSWLSAAFPGPAFDFWQPLQAQNLTSSRPLQSRPPASRRPARARPRPRPHSGLS

SEQ ID NO: 778045 - protein, 243 aa, Homo sapiens
RNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKG

SEQ ID NO: 778046 - protein, 56 aa, Homo sapiens
GEGTGLRMGLRSKTETLIQRETTIGADPFICPGNVLPRLESSAQNKGKGVQLPPWQ

SEQ ID NO: 778047 - protein, 53 aa, Homo sapiens
QPSQGCPELATLTRVSKSNGHRKIHLVKPNQDWQSCQADHLRRMRNKHSLLHA

SEQ ID NO: 778048 - protein, 68 aa, Homo sapiens
MGVPHRCPSHPNPEHQASRGAQPRNIPGLERPSHLHAARLWLRRLLLGAWWSQAGGRAGDCSAEPRPR

SEQ ID NO: 778049 - protein, 33 aa, Homo sapiens
AEQRPWLLPTPCQEHLPVVTATSDPDTVQCPLG

SEQ ID NO: 778050 - protein, 92 aa, Homo sapiens
RIEPVPSGTSKTVKDESGGERGLTPVMAAFEEADAGNTGVNHRAQPRVVTFLYTCEITTIKTMIKSTAPEIPHVLMPFAIPPRFLFLSPGNH

SEQ ID NO: 778051 - protein, 106 aa, Homo sapiens
GLSLALSLSPRLECSGMILVHYLQGSCNAPSSASCVAGIRGSHHHVQLIIVFLVEMRFHHVDQAGLKLLTSGDLPILASHSAGITGVSHSARPPLLSLNSPGHCLG

SEQ ID NO: 778052 - protein, 125 aa, Homo sapiens
EEILIYVANKCRFLLRNGYSPKDIAVLFTKASEVEKYKDRLLTAMRKRKLSQLHEESDLLLQIGDASDVLTDHIVLDSVCRFSGLERNIVFGINPGVAPPAGAYNLLLCLASRAKRHLYILKASV

SEQ ID NO: 778053 - protein, 129 aa, Homo sapiens
EEILIYVANKCRFLLRNGYSPKDIAVLFTKASEVEKYKDRLLTAMRKRKLSQLHEESDLLLQIGDASDVLTDHIVLDSVCRFSGLERNIVFGINPGVAPPAGAYNLLLCLASRAKTIKWFSSLINCETI

SEQ ID NO: 778054 - protein, 77 aa, Homo sapiens
EPVVAQATVRWLTRPGCSRNTSVAATALAMAHEGSVSFSSAGDAPEPGSAVKVGVGNSGLALGRPVPLLAPAHRAGV

SEQ ID NO: 778055 - protein, 112 aa, Homo sapiens
PTFAVLSHPVCGNLLQKPQETNTTGKPSSCTRQLQSGASVPLVHSPTPEWGLCSPGTLANSGVGPLFPSYTRQLRSGASVSLVHSPTPEWGLCSPGTLANSRVGPLFPSYTR

SEQ ID NO: 778056 - protein, 36 aa, Homo sapiens
ALPKQPVDGKAPLATGEDDDNEVPDLVENFDEASKN

SEQ ID NO: 778057 - protein, 102 aa, Homo sapiens
LDGYSTPPDGVGLGRRVQNIKGPLPLSGKDTKSSSASSLYTSDIISWPGAVAHARNPCNPSTLGGRGGQITRSRDRDHPGQHSETLSLLKTQKLAGCGGTCL

SEQ ID NO: 778058 - protein, 66 aa, Homo sapiens
NKMKELELLCSMKEVSFDGNDLENMVLSLREKFLQEVNSLIQKPSHPLAKTKTLVKSLMNRAELLL

SEQ ID NO: 778059 - protein, 70 aa, Homo sapiens
GITGSPPYSGTPAPPPENTHLGVPPMEAAGPGSSEGWCCCCPVQDGSASSSQKPRLPCGLPTWLQLLNVW

SEQ ID NO: 778060 - protein, 95 aa, Homo sapiens
AWGRVMAEGQGRSGGVTASSFGLVCLAAGPRMHTGTPGGLVKMQALAQLVWGTQHLGWLRLWSFPDHALRCEECGKGLLHKPGEASPEQDPQYPH

SEQ ID NO: 778061 - protein, 129 aa, Homo sapiens
EPNKLVSFQEMAPGKQETRAGVVHGAIGEAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 778062 - protein, 113 aa, Homo sapiens
THPPTQSLGNGMGSFTVLSWKDLCQAIPFIPLFHRHPSKIKIPPISKQLKQKLFCHLSPSLLHVFVPFWFLPGIPSLSGNEVFLEFPRAVQALSLLKMKHGGSQGQTALPGLT

SEQ ID NO: 778063 - protein, 70 aa, Homo sapiens
RFGCWMCGPWSERRRFGCWMCGPWSERRRFGCWMPGPWSERRHFGCADLLHSPPRPQRRRTPASISKTII

SEQ ID NO: 778064 - protein, 92 aa, Homo sapiens
GTRKKIGNKMWVRPTVPCRPEISVWPEQAYRKAVPGGRKCGASLSWETPELERKSVTKCGFGQQCPVGLKFRSGQSKHTERLYLEEGSAEPA

SEQ ID NO: 778065 - protein, 92 aa, Homo sapiens; identical to SEQ ID NO: 778064

SEQ ID NO: 778066 - protein, 105 aa, Homo sapiens
GTRKKIGNKMWVRPTVPCRPEISVWPEQAYRKAVPGGRKCGASLSWETPELERKSVTKCGFGQQCPVGLKFRSGQSKMVLPFKVYYLNISMALVLTAFTVSFMGS

SEQ ID NO: 778067 - protein, 105 aa, Homo sapiens; identical to SEQ ID NO: 778066

SEQ ID NO: 778068 - protein, 168 aa, Homo sapiens
AQPASGRAPSLPLDRRPPGTAAPGVRTGARVRGLNPFGPADATRLGEAGSRHLPAGRTGGAPGFRVSRWPGDAGEVTGWTAEALRGQRRRSGSPPGGSQSRPVGRECGAAGWEGRGSRKPGSPARTPTSRWPGAQGGQTDLCKHSFESNSRRDDLPEGRLSEFCRGGN

SEQ ID NO: 778069 - protein, 261 aa, Homo sapiens
MQLVILRVTIFLPWCFAVPVPPAADHKGWDFVEGYFHQFFLTEKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 778070 - protein, 55 aa, Homo sapiens
MALLSGVYLWFFVLVEKESGHGHTQRVSLRAESLIDKEQEREKMRPHAEKAGCPR

SEQ ID NO: 778071 - protein, 114 aa, Homo sapiens
MSGAGLGIRRVYRALGLDTVSGVCAFRAWWSSQATGHMKTKVRPPFQKVLPHTHTQKEEMHAQRGQEEIQRDRPCWVSPLRLFTFDHCPFCPVISLHSCPCVLETQHKSGQFSL

SEQ ID NO: 778072 - protein, 108 aa, Homo sapiens
MNHAFSTERPSSLVNAPPEMSKNSVPEPGWLHENHLRAFANIGPYWLQMYSSLGEEERGRTRNRMGRNQPCAQEDAGIPPASLAQCSLFYKVTEAQRGKPAQVLIACK

SEQ ID NO: 778073 - protein, 79 aa, Homo sapiens
CLWSSLAGSPMGWAQLGSSSVPCDGTGAAVIQRLNWAERARFLAHVAISGAGCCWELHWTSVQSSSAHLSVSLPCGSGF

SEQ ID NO: 778074 - protein, 107 aa, Homo sapiens
KIHRSSSLNLCLPNACSSLARNPNNIKPFVSKKSLKALFPHFPRIGFVTVREAEARPAYFSLGAFIQPLKLCLLFTKVGCAYFTVFILITFHIHLHVDSCGRLQNGP

SEQ ID NO: 778075 - protein, 69 aa, Homo sapiens
GAVPVLPAHAGAQRDRWARTPPCGDEAPSSPATPQPPLAPHPTPKGPPSAQDRVWEKVFARRVGRERGG

SEQ ID NO: 778076 - protein, 199 aa, Homo sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVEPGADREETRVVDSDYTQFALMLSRRHTSRLAVLRISLLGRSWLLPPGTLDQFICLGRAQGLSDDNIVFPDVTGGALDLSSLPWVAAPA

SEQ ID NO: 778077 - protein, 131 aa, Homo sapiens
MLSTRAQAHVLVCTHLHTPAHSLCQASWVCSESGGPWGQGQVRGFLRTWGCWEPLWATSSAPSQPPSPQPLPLDPLLVPFLPPASHLKPPAPPLCPPLLPPGLCPLLPLCPPSRLHLPHQAGHPRPASVEG

SEQ ID NO: 778078 - protein, 160 aa, Homo sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVGRSWLLPPGTLDQFICLGRAQGLSDDNIVFPDVTGGALDLSSLPWVAAPA

SEQ ID NO: 778079 - protein, 199 aa, Homo sapiens; identical to SEQ ID NO: 778076

SEQ ID NO: 778080 - protein, 156 aa, Homo sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVDTRAGWPSSGSACWAGAGCCLPGRWTSSSAWAELRASRMTTLSSQM

SEQ ID NO: 778081 - protein, 160 aa, Homo sapiens; identical to SEQ ID NO: 778078

SEQ ID NO: 778082 - protein, 156 aa, Homo sapiens; identical to SEQ ID NO: 778080

SEQ ID NO: 778083 - protein, 221 aa, Homo sapiens
VPVGPAAARMRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVGRSWLLPPGTLDQFICLGRAQGLSDDNIVFPDVTGNMVHLQACWAVGTGPAGMSLVDPRGAGPSVYPGSSAPACAQGSPGSWVPVLKPGSEPPPAAPGPLSW

SEQ ID NO: 778084 - protein, 82 aa, Homo sapiens
SVREGKQAREGRTATGQGHHVPARPRFQGEWFVLGLAGNSFRPEHRALLNAFTATFELSDDGRFEVWNAMTRTSGGRGRRIT

SEQ ID NO: 778085 - protein, 81 aa, Homo sapiens
KRAEWRENIDTVLNWFTKEEFDFVTLYYREPDNMGHRFRPEAENRKLMIQQINRTIGYLVGATEKHSLQSTSASSSHETMG

SEQ ID NO: 778086 - protein, 58 aa, Homo sapiens
MRQVCLHLADENLSEEVQDHTASTGLWCRAVSKAHRSTTRLCSQRGRWNLRDFWKGSL

SEQ ID NO: 778087 - protein, 130 aa, Homo sapiens [sequence omitted]

SEQ ID NO: 778088 - protein, 130 aa, Homo sapiens [sequence omitted]

SEQ ID NO: 778089 - protein, 63 aa, Homo sapiens
PLQRWCHMEGRWDRKSGREGDQGGDDTYGGAMRGAGPLALDFLQQPSHGKSPPPTSQGWVAGH

SEQ ID NO: 778090 - protein, 100 aa, Homo sapiens
VGWGDQSGSQECHSSALCGWAVVRIITKGVIPSRICITHKGWAVVLPCLVRRPALCHPPGWAQPQVGNVVPPGQMPRTVEKQRKVREKRLRPAGVKAGDL

SEQ ID NO: 778091 - protein, 176 aa, Homo sapiens
WLECHPPTGGIVGQCILGADQGDEETRPWSTAPTCCVWCWEAGSCCSRGATPGSRASGDQSEDAVSTWLAGAPQPPPPTSSGSLSAKWGLLVLQDNPASPTLCSDTKQSSDSPSLGIRRAPYNTHILSRVLDQSLLVSVAAITHYHKLGSLKQQKFTLTVLEARSLKSRCQQYCAL

SEQ ID NO: 778092 - protein, 145 aa, Homo sapiens
LVFLRDNLCHCHVSEDKWREICPASWWHSESAMEQHSLRLRMDRKKALSSSCQRREIPCGRSGCRAPGKCLPDPSLWQNLKGHCDLYQVTQCLALGKGGAWSRHRRSRGEALSSPDRSAPFCCSRHYLQQSGAYSSRLSDDFSLS

SEQ ID NO: 778093 - protein, 249 aa, Homo sapiens
GRRSRLRPDHTGGTLSYFRASPGPQRPAWPRWRFGREARESDPSGRLRVGGAGCAARDPSGSRAGSSSRAAACRPGRPRGGAPSGPGEAQKRVDWRGSAGERRAHRGPLARTRSAACSAFRAGEGARPCSPSPGMGRAASPGAAWTASSPPPVRDSRLPKVAGAGARDKIPESGQPISEVAGNRTGRSLRTPGLAQAVRTLGRLQHLGELPAPWPSSLACLIPLQRLSPSESALPGDRRGRTLPTAPRT

SEQ ID NO: 778094 - protein, 33 aa, Homo sapiens
MTWAHPDHPGTSPHPHVLHFIVCKVPYATEGDT

SEQ ID NO: 778095 - protein, 948 aa, Homo sapiens
GFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVAMRSRSIGECALPSAYIRSAKSAPVLIHTSKPFLPDIVLTPLSDELSDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLGNISKLDIYLFSFRASVSGDHK

SEQ ID NO: 778096 - protein, 600 aa, Homo sapiens
GFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVG

SEQ ID NO: 778097 - protein, 417 aa, Homo sapiens
MLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGKVIHGNVFLKCIF

SEQ ID NO: 778098 - protein, 336 aa, Homo sapiens
MLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKGAVPVIDSSSRHAPSLQSSTEASSITRSTESHITDTHSRESSLEVGDSIYDHLCHLIGPVELADSAFEQIQYIDLEGDDDLLSTLKEYFKENQENHSKNETGKDPA

SEQ ID NO: 778099 - protein, 726 aa, Homo sapiens
GFSAPQSEHGPRTLDNLINPPLNLQETQVTIEEITPLVPPQSGDKGQEDLTSYFLEALLKYIVIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGKVIHGNVFLKCIF

SEQ ID NO: 778100 - protein, 423 aa, Homo sapiens
GFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTW

SEQ ID NO: 778101 - protein, 277 aa, Homo sapiens
GFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQVTYLSVFLIYKEGFYL

SEQ ID NO: 778102 - protein, 161 aa, Homo sapiens
GFSAPQSEHGPRTLDNLINPPLNLQETQVTIEEITPLVPPQSGDKGQEDLTSYFLEALLKYIVIQRAAASLVSREESKNDNADKTDRTTEPEQSHSNTSTLTEREPSSSSLCSIDEEHLTDIEIVRRVFSSKRSNVNFVTEIFRQVTYLSVFLIYKEGFYL

SEQ ID NO: 778103 - protein, 85 aa, Homo sapiens
SALQVRMVAAEHRHSSGLPYWPYLTAETLKNRMGRQPPPPTQQHSITDNSLSLKTPPECLLRPLPPSVDDNIKECPLAPLPPLSG

SEQ ID NO: 778104 - protein, 165 aa, Homo sapiens
KRARALGAGSVALQFSGQELHGSGPWAWAFDLGPLLGVVLILLLAEAHTGLLQVQAARLRMGGSSQSQQLHSSGAEKFMFATLRSQLWKGGQWRALPWPLSHTQAVLGGQGPGVVKDPLGAFAFQEQALVFHITLTKAGGFSGCDQLATADSSGVVLFLNISSCC

SEQ ID NO: 778105 - protein, 119 aa, Homo sapiens
AVSPPDRERLSQLWVLEATHLKTWQGAGIGEGWMVRVSDAITQLVTKPGSKPKRSSVPPGPVSNSSSSPAASLGLLAETVQMLGEWEESRGDPIHVTLGPKVGCGKQGKEHWIGSQAWV

SEQ ID NO: 778106 - protein, 86 aa, Homo sapiens
ATYRVGGRDQLVLAGKAPILRLPSLPAGGILMGTERGEVRHIPQVVSGRDKAVAILLLAASLLVQRATPRGSRPVTMCPDVKAAVA

SEQ ID NO: 778107 - protein, 69 aa, Homo sapiens
RRGAPLGSPLERRAAPAHEESGVRSSPPAGGCAPPAGTLRGPQPDARSDLTVNVRFACSHCIVAGLGDR

SEQ ID NO: 778108 - protein, 109 aa, Homo sapiens
PSFFTSSGSGFEAFFTAAGTLVVAVCTRKEYLTMSLPEVSFADSAWHCVAIVHVPGRRPFSQNLVHVYKDGHLVKTAPLRCPSLSEPFSSCCIGSAGYRTTTTTTGLPT

SEQ ID NO: 778109 - protein, 80 aa, Homo sapiens
YGISSTTRSADAWLEVLFYDYAYHTVSLLDILEQASYRVRFEEVIEYVTEPSEALIFTDGWANEKKKMKLNFMIHPKTTF

SEQ ID NO: 778110 - protein, 232 aa, Homo sapiens
ASARLGVESAEGPRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKKIGPFG

SEQ ID NO: 778111 - protein, 68 aa, Homo sapiens
LLLFRVFFYFYVNCVSFYFFCLLITFTAFTFSLLFLLFFTFFILFFLFFLLLLLFRVFFYSIYNFLNL

SEQ ID NO: 778112 - protein, 721 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778113 - protein, 719 aa, Homo sapiens
SLQYGYCSEAWVCARCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778114 - protein, 717 aa, Homo sapiens
GVRYEAGVDRPRRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778115 - protein, 718 aa, Homo sapiens
ASARLGVESAEGPRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778116 - protein, 721 aa, Homo sapiens; identical to SEQ ID NO: 778112

SEQ ID NO: 778117 - protein, 721 aa, Homo sapiens; identical to SEQ ID NO: 778112

SEQ ID NO: 778118 - protein, 721 aa, Homo sapiens; identical to SEQ ID NO: 778112

SEQ ID NO: 778119 - protein, 444 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKEICKKKKK

SEQ ID NO: 778120 - protein, 721 aa, Homo sapiens; identical to SEQ ID NO: 778112

SEQ ID NO: 778121 - protein, 540 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVRAITSYLVTWVLGSMTDVIAATFMSFF

SEQ ID NO: 778122 - protein, 721 aa, Homo sapiens; identical to SEQ ID NO: 778112

SEQ ID NO: 778123 - protein, 721 aa, Homo sapiens; identical to SEQ ID NO: 778112

SEQ ID NO: 778124 - protein, 725 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEERSEETS

SEQ ID NO: 778125 - protein, 721 aa, Homo sapiens; identical to SEQ ID NO: 778112

SEQ ID NO: 778126 - protein, 553 aa, Homo sapiens
LGARLGGAERHKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778127 - protein, 322 aa, Homo sapiens
EYRASEAAVNRTRADAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778128 - protein, 554 aa, Homo sapiens
SLAGDMMYGWVGDSLSLAGDMMILKYRKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCHVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778129 - protein, 697 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKEGRDSQMRGAPGRKEGNRGIFDGGFSSSEGTEAGPEAYNEGLGKG

SEQ ID NO: 778130 - protein, 553 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLVGYCES

SEQ ID NO: 778131 - protein, 374 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQRNLEQWET

SEQ ID NO: 778132 - protein, 374 aa, Homo sapiens; identical to SEQ ID NO: 778131

SEQ ID NO: 778133 - protein, 721 aa, Homo sapiens; identical to SEQ ID NO: 778112

SEQ ID NO: 778134 - protein, 771 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKEICKKKKNEPGKKRSWTRWMPHILRNPRGRVQWLTPVIPAFGRPRRADHEVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778135 - protein, 703 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCHVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778136 - protein, 634 aa, Homo sapiens
VTNPRPSPHVVGGFQKRCRHRIAQLFAVGALVCCLVLLHLSAMISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKVITSCLLNFNLSKAQS

SEQ ID NO: 778137 - protein, 721 aa, Homo sapiens; identical to SEQ ID NO: 778112

SEQ ID NO: 778138 - protein, 522 aa, Homo sapiens
MARYEAGFEFGRGLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778139 - protein, 368 aa, Homo sapiens
VFCDDSLNLPPLHTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778140 - protein, 295 aa, Homo sapiens
MRISPPSYWISSIQALDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778141 - protein, 264 aa, Homo sapiens
RGTKIKAGTGCVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 778142 - protein, 540 aa, Homo sapiens; identical to SEQ ID NO: 778121

SEQ ID NO: 778143 - protein, 75 aa, Homo sapiens
TTTKFGGVDEISKMRELLARKDSETGENIRQAASSLQQASLKLFEMAYKKMASEREGSGSSGTGEQKEDQKEEKQ

SEQ ID NO: 778144 - protein, 66 aa, Homo sapiens
ESHQQLCCQRFERLSDSAKQELMDFKSRRVSSFRKNLIELAELELKHAKASTLILRNTLVALKGEP

SEQ ID NO: 778145 - protein, 78 aa, Homo sapiens
SPLCVSFLTDGRVSGMFVAKASQPPQLRASVRLLVLGLSQELGGLPGGMQWTRSFLSSLRESLPRDCHCRRIAAVHAA

SEQ ID NO: 778146 - protein, 68 aa, Homo sapiens
SVLPLLTGLLGASVFDPGTTTGTHSGKVDGSSRLSNRVLTCAGQWHLHHWTRKALDMAHPLLPFLRQM

SEQ ID NO: 778147 - protein, 76 aa, Homo sapiens
MILLRPSSTTAPACGRLASQVTMTPGVFPFIVWHPKHQGMMVGMGRKDSHVGDEAQSKRGILTLKCLIEHGIITNW

SEQ ID NO: 778148 - protein, 78 aa, Homo sapiens
MRDDGEQPTDLSLIYNYSSLSSTRWGTEVQFPGESRLLKRPSDRLQPLLSQVLSTTLYHQYPTLILMPKVPLDTRDTL

SEQ ID NO: 778149 - protein, 70 aa, Homo sapiens
KANVGNGGLASPSSWTERAAITWAMETKRASLSHTGMEAQSSRITTPAQSSRKRCGEGNDHDTDAHGVSP

SEQ ID NO: 778150 - protein, 276 aa, Homo sapiens
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTPWTPRDLVSSQTQTQSCVPPTAGARQAPESPSTIPVPSQPQNSTLRPGPAAPIALVPVFCGLLVAKSLVLSALLVWWGDIWWKTVMELRSLDTQKATCHLQQVTDLPWTSVSSPVEREILYHTVARTKISDDDDEHTL

SEQ ID NO: 778151 - protein, 270 aa, Homo sapiens [sequence omitted]

SEQ ID NO: 778152 - protein, 258 aa, Homo sapiens [sequence omitted]

SEQ ID NO: 778153 - protein, 41 aa, Homo sapiens
QCGCGGGTQREWALLAEHRLGNSLKTELVKPPTCAFYMNSL

SEQ ID NO: 778154 - protein, 178 aa, Homo sapiens
AGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPG

SEQ ID NO: 778155 - protein, 135 aa, Homo sapiens
PTRVSSSTALNLQHWLPTGSPDAWPSNWNISSTPGIQLHSPQTGTSAPCRVSRCTALKLEHQLPAGYPAARPSNWNISSPPGLQLHGPHTGTSAPHQISSCTALKQEHQLPTGSPAARLSNRNISSPPDLQLHGS

SEQ ID NO: 778156 - protein, 136 aa, Homo sapiens
TCRVCTCPVALGLQIGDADTALLLVCAKPAQPASSPARPPRPWAPGGPPYPAPTKQQARSWRASFPDRERGQSRADGSDQRTTAPQGPPTVLGPRPPVPRPPRGLRRSWDAHWLRPGATLCPSVTPHGGSHHPSRA

SEQ ID NO: 778157 - protein, 26 aa, Homo sapiens
MTICILLPAFSLNTTVLNPEPSRESY

SEQ ID NO: 778158 - protein, 73 aa, Homo sapiens
QIFRWGNLLNQVKQIFHHRDNSLMDPWISPQNFLIPNSTYRRKLCYAFPGNRTETIPGYTTYQNSPAASTGFA

SEQ ID NO: 778159 - protein, 33 aa, Homo sapiens
KKNVGNSPTPARLWVNDGDMQVAEELRPLLRSR

SEQ ID NO: 778160 - protein, 100 aa, Homo sapiens
RGLGEPRGVQGWSFPPALRHYTLNPARMVEAGTDYQPYLTYGKTEKETLGQGHPAGAGVPSPSLGRYFVPPPHSVGRCWSMRGRPWIGIEVGGVTTGASI

SEQ ID NO: 778161 - protein, 93 aa, Homo sapiens
PEDGEPIDHDCQQIIVQTYAARDDLVEVPLTNPDLNLYTDGSSFVENGIRRAGYAIVSDVTILESKPLTPETSAQLVELVHHPLTLPLPTTKS

SEQ ID NO: 778162 - protein, 81 aa, Homo sapiens
LPSQHPTSRTSPASPTSPGPSPPSSSTQERENCYFRFPSPSRQRHLLQEHPPLHQAPTGQPPPAPPWSRGEGFITWALLTF

SEQ ID NO: 778163 - protein, 152 aa, Homo sapiens
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDS

SEQ ID NO: 778164 - protein, 131 aa, Homo sapiens
AQYIQSSSKFITKSDFSSPPMLPGPSTIIPHLDYFNNDPSFFFPKISKHYSQGNPFLLKTLQLSKVSQSLIKTNRMCLPVTLLISSLSNLFFILLKSQLYLFQEHALHVITSEHLYVNYSSSGILFFQGST

SEQ ID NO: 778165 - protein, 142 aa, Homo sapiens
IKLREKRISSLHYTVSTIANTYSITFSKHKALCGGCSMGNLLWNSDLSVCDSEKKHHINIGEDRRTSRKTQESGLDNNTYHLLYSHHIPGFSFNSYKGLQRWALASPFSNEGHGALLVYITCPILVVEADFSQKSALLWIDA

SEQ ID NO: 778166 - protein, 904 aa, Homo sapiens
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSSVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 778167 - protein, 71 aa, Homo sapiens
DCITVSAFSSAAAPPSLSDNIPHPCHLGFRLPLGGTGKLGSTSRGPSVYFCRSKSNGQDHLASDLAPHNLS

SEQ ID NO: 778168 - protein, 400 aa, Homo sapiens
GVGSTSRALPGCEVWLGYGPRAAAAAAATVLFGGAGPTETMFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSNIPSLQNSLNGSSAGRKHS

SEQ ID NO: 778169 - protein, 383 aa, Homo sapiens
GVGSTSRALPGCEVWLGYGPRAAAAAAATVLFGGAGPTETMFVARSIAADHKDLIHDVSFDFHGRRMATCSSDQSVKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSNIPSLQNSLNGSSAGRKHS

SEQ ID NO: 778170 - protein, 135 aa, Homo sapiens
MISAHCNLCLLDSSDSCALASQVAGITGVHHHAQLIFVFLIETEFHHVGQAGLELWVQEILPPCLPKCWDYRCEPPRMALNLLFLGIPKFSTFSALEFVNIFVEYHMTVIPECSNLFMIYLGKFTTVLLFAIIWL

SEQ ID NO: 778171 - protein, 58 aa, Homo sapiens
GFSSIHGGTCVSRRILQCPRQDVCGEKDSPVSMVGSVWREGFSSVHGRTCVARILQYP

SEQ ID NO: 778172 - protein, 104 aa, Homo sapiens
VAVTTWLGAGKKNTLKPNFWQRSMSSGEGDSSPSLRMLPTAHRHLSGATREQVLCCTVTDGLPISLHHSRPLGKKVQDPVGVVIVDSGAELGDAAALSEKPPSL

SEQ ID NO: 778173 - protein, 192 aa, Homo sapiens
MRSRGSDTEGSAQKKFPRHTKGHSFQGPKNMKHRQQDKDSPSESDVILPCPKAEKPHSGNGHQAEDLSRDDLLFLLSILEGELQARDAVLAILQAEKMEPGLLEAQYAVVTPKSVRRSPGEMLSKRNLTLGGGLLVNMVRGHVGATYDFATRELWENPGPIGWATRLTLERIMQKRKTPGGMYIRIEPERTH

SEQ ID NO: 778174 - protein, 111 aa, Homo sapiens
MRSVAYEVLDLFNPDDWILMFAAKTGPNAYRSTQHKVKSAYMLDSSLGGVACKNYIFKGDMQKLVPFFTELHLLLAQDAEKIKKEIRRNYWTCRSGHGHCHKGAAVQKECV

SEQ ID NO: 778175 - protein, 111 aa, Homo sapiens
SPHPLLYPEVLLSLHQPPKYIPTYPLPYIPKCAFPSPGHIIGKISSAEASYPSYPTGLLAFHLIPAWYIFLHTRAKVIIFKHELEHSSFLSKTPQWLSSTLRKENPNLSMT

SEQ ID NO: 778176 - protein, 88 aa, Homo sapiens
LIRRAHASAFLCGRRGGPACDRACVGGRACVSVRPDHGGLWVGRIVHARPICAPQASLALLVPVPACCYQLVNMWHLPGHCDESGMSI

SEQ ID NO: 778177 - protein, 75 aa, Homo sapiens
VNRGVRKRNLEMDVLMVHVTGVYSNRMSKRDVRYAKMIDARHWATALQPRQQEKLRLKQKNKQTKNYENPQPTLQ

SEQ ID NO: 778178 - protein, 158 aa, Homo sapiens
MFCHYHQTANATQRVVNNGNETGTISTVDHAVVEGERNRQHQTRHELFTIPHRLHRGLGNAEDSHFRRVHNRREVGSTQAADAGDGEATALHFARSQLTVTRFLEIVISSRDSSMMPFLVTSLNTRNNHTVRGIHRHTRCWMEFLSRSERLTRSDRRN

SEQ ID NO: 778179 - protein, 67 aa, Homo sapiens
LHTPLTASNAADCIQTPLTASNAADCIQRSQQSSFIEINVLVAQGDKVLTFISLPPEIPLNDGKIIN

SEQ ID NO: 778180 - protein, 101 aa, Homo sapiens
ARYPGKMTQTICNTIAAFAIWSPLLSFCRNCFLEGYPHHLIARTTVLSPYSHFRLADSNYFISRKVVTTFFLTLKLTLDSLTVFWLITYLSEAHCSAKYIF

SEQ ID NO: 778181 - protein, 47 aa, Homo sapiens
APRSGDPTRCPGPPVPGFLGNKLFQPNRSLCRWEDGDREGAGERASG

SEQ ID NO: 778182 - protein, 153 aa, Homo sapiens
HGWDPLRPYPMHHSLWLVLLVSFCYNKTVIISMYFSELYESFYQIIKPECIPRTLKLNQGVEVEVAPFTITPSDPLAKFLLPVPATLCSASLEILVPEGGMLPPGDTTMIPLNWKLRLPPGYFGLLLPVSQQATKRVIVLAGVTDPHYQDEIS

SEQ ID NO: 778183 - protein, 245 aa, Homo sapiens
VRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLL

SEQ ID NO: 778184 - protein, 196 aa, Homo sapiens
MRYSFPLTVLEGEDPGISERGPWMLKSSWVPDSMLSRPSYYDALHNRSSGHAQRPAGHSASPAQHLLRGPPSEAAGRRGGSPRCHLGPPGPQNPQHPPGQEERMGVINTWLTIVIRGTDFGGTSLGYLSLPVFLEKLIKFGHLRSATKLTYKMLSFLEELIFPVSKWTLWDPRLYQHKTTRSTDGTHAGLTLVPAD

SEQ ID NO: 778185 - protein, 129 aa, Homo sapiens
PSLTQMTAPPDHLPSNQSDNSRAETLLTSPLGNPLPSFAGSDTTFNPLFLPAVNGASGLMTLNPQLLGGVLNSASANTANHPEVSIATSSQATTTTTTTSSAVAALTVSTLGGTAVVSMAETLLNISNN

SEQ ID NO: 778186 - protein, 88 aa, Homo sapiens
NGDDDVANHKEASDDGSNDDKEDDASDGDEDEMVTMMMMMTDVVMMISSVYFEHFLQAKNLPCILSSQPLPFKMWPMDQQHGCHLSTC

SEQ ID NO: 778187 - protein, 68 aa, Homo sapiens
YDDEEFEYRHVVLPKDIAKLVRKTHLMSESEWRNLGVQQSQGWVYYMIHEPEPHILLFRCPLPKKPKK

SEQ ID NO: 778188 - protein, 68 aa, Homo sapiens; identical to SEQ ID NO: 778187

SEQ ID NO: 778189 - protein, 68 aa, Homo sapiens; identical to SEQ ID NO: 778187

SEQ ID NO: 778190 - protein, 120 aa, Homo sapiens
SFLETHPEPPPSDTMVNSCCGSVCSDQGCGLENCCRPSYCQTTCCRTTCCRPSCCRPSCCRPQCCQSVCCQPTCCCPSYCVSSCCRPQCCQTTCCRTTCCRPSCCVSRCYRPHCGQSLCC

SEQ ID NO: 778191 - protein, 180 aa, Homo sapiens
SFLETHPEPPPSDTMVNSCCGSVCSDQGCGLENCCRPSYCQTTCCRTTCCRPSCCVSSCCRPQCCQTTCCRTTCCHPSCCVSSCCRPQCCQSVCCQPTCCRPQCCQTTCCRTTCCRPSCCRPQCCQSVCCQPTCCCPSYCVSSCCRPQCCQTTCCRTTCCRPSCCVSRCYRPHCGQSLCC

SEQ ID NO: 778192 - protein, 368 aa, Homo sapiens
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSGRMVSGF

SEQ ID NO: 778193 - protein, 168 aa, Homo sapiens
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPERRLPKSRP

SEQ ID NO: 778194 - protein, 305 aa, Homo sapiens
MRRNTQDENMRKWFKVTICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSGRMVSGF

SEQ ID NO: 778195 - protein, 397 aa, Homo sapiens
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQRWWCLLSLKWKDGLRVLILPSCGPSSLPLAAIPVCAS

SEQ ID NO: 778196 - protein, 302 aa, Homo sapiens
MRRNTQDENMRKWFKVTICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQRWVGG

SEQ ID NO: 778197 - protein, 217 aa, Homo sapiens
PPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFSLKNAILQ

SEQ ID NO: 778198 - protein, 177 aa, Homo sapiens
MDMMLLVQGACCSNQWLAAVLLSLCCLLPSCLPAGQSVDFPWAAVDNMMVRKGDTAVLRCYLEDGASKGAWLNQSSIIFAGGDKWSVDPRVSISTLNKRDYSLQIQNVDVTDDGPYTCSVQTQHTPRTMQVHLTVQAPSTAQYGITGSADVLFSCWYLVLTLSSFTSIFSLKNAIAT

SEQ ID NO: 778199 - protein, 177 aa, Homo sapiens
MDMMLLVQGACCSNQWLAAVLLSLCCLLPSCLPAGQSVDFPWAAVDNMMVRKGDTAVLRCYLEDGASKGAWLNQSSIIFAGGDKWSVDPRVSISTLNKRDYSLQIQNVDVTDDGPYTCSVQTQHTPRTMQVHLTVQAPSTAQYGITGSADVLFSCWYLVLTLSSFTSIFSLKNAILQ

SEQ ID NO: 778200 - protein, 150 aa, Homo sapiens
MDMMLLVQGACCSNQWLAAVLLSLCCLLPSCLPAGQSVDFPWAAVDNMMVRKGDTAVLRCYLEDGASKGAWLNQSSIIFAGGDKWSVDPRVSISTLNKRDYSLQIQNVDVTDDGPYTCSVQTQHTPRTMQVHLTVQGMYFQNCYIVKDCA

SEQ ID NO: 778201 - protein, 118 aa, Homo sapiens
EGLADGWALVTKATGKRVAVDTGWFIDLLRSQGDFPADNSRGSIAELSEALLLSAVTRSFSVENKGEDVVTGPLHGCAVNELTCIKHQEQCQNVVGSHVNSHQYCEFCVLHRMEGEVI

SEQ ID NO: 778202 - protein, 139 aa, Homo sapiens
TRSSSPQTITFDACLVIPCGDLQSQKQLSDSEKYLCPFKIKGSPYQDPCSLTNAGKQVCHSWNDVVWTTEYQGWTSSTGGCMSLKPYIHFTKESTPHNCQYNQCNPVQISILIPTSTDPKPTLSCLYGMGAEIAGAHLI

SEQ ID NO: 778203 - protein, 71 aa, Homo sapiens
QKEATQCSSSEAETQEAEHGSALLWKHGWNTWAWPEQAQVSLWGDERHVVLVPHSQRLIQSANLQEPSIAT

SEQ ID NO: 778204 - protein, 428 aa, Homo sapiens
MALSGNCSRYYPREQGSAVPNSFPEVVELNVGGQVYFTRHSTLISIPHSLLWKMFSPKRDTANDLAKDSKGRFFIDRDGFLFRYILDYLRDRQVVLPDHFPEKGRLKREAEYFQLPDLVKLLTPDEIKQSPDEFCHSDFEDASQGSDTRICPPSSLLPADRKWGFITVGYRGSCTLGREGQADAKFRRVPRILVCGRISLAKEVFGETLNESRDPDRAPERYTSRFYLKFKHLERAFDMLSECGFHMVACNSSVTASFINQYTDDKIWSSYTEYVFYREPSRWSPSHCDCCCKNGKGDKEGESGTSCNDLSTSSCDSQSEASSPQETVICGPVTRQTNIQTLDRPIKKGPVQLIQQSEMRRKSDLLRTLTSGSRESNMSSKKKAVKEKLSIEEELEKCIQDFLKIKIPDRFPERKHPWQSELLRKYHL

SEQ ID NO: 778205 - protein, 120 aa, Homo sapiens
MTHCNERCMAKSRNPSSESHGRLNFPAHAVTPCVTCCLLGRLVRDPSQGFTRGWSHRLPRLVPPRFQPSEERRCSAQTMWCSQLFRHSEPPSRLGHGGWEHSGNPHSQTTPRDLAHHRPA

SEQ ID NO: 778206 - protein, 258 aa, Homo sapiens
MAAADGGGPGGASVGTEEDGGGVGHRTVYLFDRREKESELGDRPLQVGERSDYAGFRACVCQTLGISPEEKFVITTTSRKEITCDNFDETVKDGVTLYLLQSVNQLLLTATKERIDFLPHYDTLVKSGMYEYYASEGQNPLPFALAELIDNSLSATSRNIGVRRIQIKLLFDETQGKPAVAVIDNGRGMTSKQLNNWAVYRLSKFTRQGDFERLENLTFFFLWVAMYFSKDKKLVCLWMHMIHWRFYCYSHIYLGFIL

SEQ ID NO: 778207 - protein, 390 aa, Homo sapiens
MAAADGGGPGGASVGTEEDGGGVGHRTVYLFDRREKESELGDRPLQVGERSDYAGFRACVCQTLGISPEEKFVITTTSRKEITCDNFDETVKDGVTLYLLQSVNQLLLTATKERIDFLPHYDTLVKSGMYEYYASEGQNPLPFALAELIDNSLSATSRNIGVRRIQIKLLFDETQGKPAVAVIDNGRGMTSKQLNNWAVYRLSKFTRQGDFESDHSGYVRPVPVPRSLNSDISYFGVGGKQAVFFVGQSARMISKPADSQDVHELVLSKEDFEKKEKNKEAIYSGYIRNRKPSDSVHITNDDERFLHHLIIEEKEKDSFTAVVITGVQPEHIQYLKNYFHLWTRQLAHIYHYYIHGPKGNEIRTSKEVEPFNNIDIEISMFEKGKVPKIV

SEQ ID NO: 778208 - protein, 73 aa, Homo sapiens
RRSEDPSLSSAPGKHNPCFHKIYVLVGETRNLSGQIQGGALGTNRKGIQHRCGEGGQLGKDTQGKENGISNTE

SEQ ID NO: 778209 - protein, 396 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778210 - protein, 396 aa, Homo sapiens; identical to SEQ ID NO: 778209

SEQ ID NO: 778211 - protein, 237 aa, Homo sapiens
PRLQEFGTSPVAQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778212 - protein, 183 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEEFECRC

SEQ ID NO: 778213 - protein, 396 aa, Homo sapiens; identical to SEQ ID NO: 778209

SEQ ID NO: 778214 - protein, 380 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKLVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778215 - protein, 301 aa, Homo sapiens
MGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778216 - protein, 353 aa, Homo sapiens
SGAEATKGRDPGAWTSPSASPPHAAAVARVPPARSVSPRSAAAAAAPWLCLSCSWRWWRDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778217 - protein, 257 aa, Homo sapiens
GTSGTSSAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778218 - protein, 215 aa, Homo sapiens [sequence omitted]

SEQ ID NO: 778219 - protein, 197 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANLFSVHSPSIL

SEQ ID NO: 778220 - protein, 349 aa, Homo sapiens
SGAEATKGRDPGAWTSPSASPPHAAAVARVPPARSVSPRSAAAAAAPWLCLSCSWRWWRDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLGEKHIFQEHKPGRKNHPGHSPNLAVDFFLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778221 - protein, 92 aa, Homo sapiens
TKHDMLLLSNFCLPKRAGERPSSPPQKSKNPASPYNLAYKYNFEYSVVFNMVLWIMIALALAVIITSYNIWNMDPGYDSIIYRMTNQKIRMD

SEQ ID NO: 778222 - protein, 176 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVSIYYKKLKGCILHFPLSAVIMNCILNILL

SEQ ID NO: 778223 - protein, 396 aa, Homo sapiens; identical to SEQ ID NO: 778209

SEQ ID NO: 778224 - protein, 396 aa, Homo sapiens; identical to SEQ ID NO: 778209

SEQ ID NO: 778225 - protein, 378 aa, Homo sapiens
RSGSDEGTGPGSLDESERVTSSRCGCRPCPAGPFRVAPQCCGRRGTMAVFVVLLALVAGVLGNEFSILRIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778226 - protein, 396 aa, Homo sapiens; identical to SEQ ID NO: 778209

SEQ ID NO: 778227 - protein, 364 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778228 - protein, 318 aa, Homo sapiens
RSGSDEGTGPGSLDESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778229 - protein, 138 aa, Homo sapiens
WRESSSVPSRDRRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 778230 - protein, 136 aa, Homo sapiens
PRDLPDHRVPPRDLRAPLHAPHLRALPPPGVLRPLLPAGRLLPPHHLLPLVVHGCGVQALLLGHHLLPACVCAVPLLPAPLRPADPLQHHLQDLLLLSHHLLPACVCAVPLRPADPLQHHLQDLLLLSSALTARNA

SEQ ID NO: 778231 - protein, 111 aa, Homo sapiens
CSLRAWLAVSRVPVAVTLAQLSVCPATLCHVFARVPWYMGPAGGAGPQADLGRASSLQLAGRVHGARGGSCLLVCLALLAPPFMFVVVVGTLTSGAPGVSPSSPQAVTGGF

SEQ ID NO: 778232 - protein, 121 aa, Homo sapiens
MLDTLCSSLFPCIGEAAKMYWPLLDCRSSTAAASCHAFVLSSPQASMVYQAFQCSRQEKQSPGKPPEKLEIGFRLQLSPSPGKGKSQVFSPTCFTLSWGNGYGDRVHANPSLLFCSEWSLD

SEQ ID NO: 778233 - protein, 137 aa, Homo sapiens
PVLAETGVLWRFSLKSSPRLEGLCMLGCWGMQGLLYLGTPSPLLLPHTAQGSITPASPTPPSFSHTRDAKLLPTVILLVSVPQLGPAAGGTSHHSLDEAPSSRPSHPCNLALSSPLPLFFLRHCHYLFLTLPTISHH

SEQ ID NO: 778234 - protein, 107 aa, Homo sapiens
GVFRELENDLMWKMHTFCARNVVSREKVLFLGSRLKDFVTSSVKIPGYQWPLLVIPNCPLDSVQSPGSSSCQGAKPFYSLCPTVKLFPPSYPQTHNPKPNKTKHCLP

SEQ ID NO: 778235 - protein, 147 aa, Homo sapiens
ACIYRENGGILRREQSDYNKIRDKRLQPESSVINSPRSLHLLSFLLRIREAQCLTGTSSGTLSFTVLQRSPEEGRPLAAQVPWGERDFCCCREWHPVGPGALGWSVKLPRTSLKDALQNVSGRPASRSTHHKREDQEGTMARVLHLL

SEQ ID NO: 778236 - protein, 276 aa, Homo sapiens
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERNYGTYTVFTYRPFQIQVKDSSGNG

SEQ ID NO: 778237 - protein, 103 aa, Homo sapiens
METDRVEGARDGDKRKEVCFVPIQGSFCFMRLTCARLVAALDIHGLSFSLRFCGSRDTKHEDITGREGQVTPLPRGTPQLCTARVGLSSPRTRGQGVPISCKT

SEQ ID NO: 778238 - protein, 119 aa, Homo sapiens
SGRKENTGGREAEEHVMETDRVEGARDGDKRKEVCFVPIQGSFCFMRLTCARLVAALDIHGLSFSLRFCGSRDTKHEDITGREGQVTPLPRGTPQLCTARVGLSSPRTRGQGVPISCKT

SEQ ID NO: 778239 - protein, 173 aa, Homo sapiens
SPDTAAGQLQEVREARFLASQMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDNISVRATILLGELLHMASTS

SEQ ID NO: 778240 - protein, 327 aa, Homo sapiens [sequence omitted]

SEQ ID NO: 778241 - protein, 327 aa, Homo sapiens [sequence omitted]

SEQ ID NO: 778242 - protein, 349 aa, Homo sapiens
GTSGTSAERTRVERRSGNRGPMMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 778243 - protein, 215 aa, Homo sapiens
MTPTGTSSTTMRLSWDGKWPRNSTNSPQRKARPVWGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 778244 - protein, 259 aa, Homo sapiens
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEDEVGHWVLPPAQDQPLVEANHLLHESDTDKDGRLSKAEILGNWNMFVGSQATNYGEDLTRHHDEL

SEQ ID NO: 778245 - protein, 247 aa, Homo sapiens
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQH

SEQ ID NO: 778246 - protein, 219 aa, Homo sapiens
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIALFFSRIYLLTFLLL

SEQ ID NO: 778247 - protein, 100 aa, Homo sapiens
LGAAPCPGPAPGGSQPPAARERHGQGAVTGPRQERGAGGHCGPDSRKEQDLGLELRVPFRWDKKRGTERGRKREGTEPQKERGTETQRPKERRTGTKTGT

SEQ ID NO: 778248 - protein, 327 aa, Homo sapiens [sequence omitted]

SEQ ID NO: 778249 - protein, 165 aa, Homo sapiens [sequence omitted]

SEQ ID NO: 778250 - protein, 294 aa, Homo sapiens
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKVQ

SEQ ID NO: 778251 - protein, 131 aa, Homo sapiens
MIAYKSGFVTNSIETEEDAEAEREGSELLKGLVQEVSEPGSAPSSTRPPELPLTLSPLSRPPADLYSAEPGEEEPAWVQTERQQFRDFRDLNKDGHLDGSEVGHWVLPPAQDQPLVEANHLLHESDTDKVQ

SEQ ID NO: 778252 - protein, 51 aa, Homo sapiens
CMGTCGPARTPHIHCTCCRATGGTAQGHTGGTCSYRHRCELISWHGPGAGQ

SEQ ID NO: 778253 - protein, 101 aa, Homo sapiens
HEGPPSSGEARMGRKRQLGTHRPEHASCSPCLSPHSCRPFTEQKAHVKRLTTIFQGMEFIKILLEAFGWNVFSPCKTGTIAVLSIGKLRIRSETSVTTETM

SEQ ID NO: 778254 - protein, 79 aa, Homo sapiens
IVGRTLGKDAYPAMLRHLPSRLPVKMWGRTLEKQSWRDSSQIPSPMSYPRLDHIVMTVKSIKDSTMCNSKILGMEVIDL

SEQ ID NO: 778255 - protein, 58 aa, Homo sapiens
MQPVHQLPCQSLAISGPRGLRTVKQLALAPLGATLAWNAAHQTGVVELLAIPKCPTPS

SEQ ID NO: 778256 - protein, 92 aa, Homo sapiens
GYSLPFTGSRTRRLSPQPGVRSVLVTKNPGSLGRRLRHLTALRGLLRCPQPLSVVPFPDHLAKHFLSPEKLLGRKAERHMTRQGSPPQRGEG

SEQ ID NO: 778257 - protein, 149 aa, Homo sapiens
VVFQRILAIIGTELAGQIWMSLLSTIQNARPLFLEKAVLGSFVPGDFLSKAFFIWKTHKAPTNGLPLSVSPLGWDLKRAPLSLAQGLVHRAGHPALPCRAHECGSRTHWPATAAAMTNISPRPGPRESHVDGKPTLLGSRVPRAQYSCR

SEQ ID NO: 778258 - protein, 43 aa, Homo sapiens
NLSKRDSQIQSLRTIRAARSCCLPQEVPLGSPQALTCSFCENT

SEQ ID NO: 778259 - protein, 464 aa, Homo sapiens
GRHGAQLRTARRGLRSAAGSRMAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778260 - protein, 459 aa, Homo sapiens
AGTGQEMLGMSAAGSRMAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778261 - protein, 255 aa, Homo sapiens
MYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778262 - protein, 447 aa, Homo sapiens
HLQYTHPDNDTINNTTNQYSSLIMMDGYSNKTRNSHPFTSESQRLTQGVGEDDEEDGVDTIEEDLTLAGEEDVKDTREEDGVDTKRGKTRHGLGRKRVQTPGMTQNQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778263 - protein, 291 aa, Homo sapiens
GRHGAQLRTARRGLRSAAGSRMAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEEKCPEQAPSTALQLQSRWSLQGPQEPEARRSKDGTPLSLTLQGQCGNTAHKKEEPLSFFGCSFKHRDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDGLRALRDPLE

SEQ ID NO: 778264 - protein, 114 aa, Homo sapiens
RKARRSAQDRAPWSEVRGRVPHGGAQEARVCGEGAAETFSSCSKWPRKEGTPDAGRPKSTKESDTLALRPRLPDGSTLPAGLLRATSPVGRSPAAVGAPRTPPAGMTQKNQESS

SEQ ID NO: 778265 - protein, 497 aa, Homo sapiens
GRHGAQLRTARRGLRSAAGSRMAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDQILMTSQREEELGSINQRRNFKNPNNVLIEQAELEKQQSLLQEKSQRQHTDGTTIS

SEQ ID NO: 778266 - protein, 530 aa, Homo sapiens
GRHGAQLRTARRGLRSAAGSRMAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEEKCPEQAPSTALQLQSRWSLQGPQEPEARRSKDGTPLSLTLQGQCGNTAHKKEEPLSFFGCSFKHRDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778267 - protein, 369 aa, Homo sapiens
PTSGNESLDLEVSCILGHQKRLCWFLKDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 778268 - protein, 203 aa, Homo sapiens
MSIFLQLGVERLLVESVHSLDHKSPAPKEGLLLGSAAAISEDGHRLHVDDTASRCLRTVFLQAPGRCFNWSPGIHTNFLCYEWHFRFVISSKPSKAEKKSFLTDKRTQSQKGKTTAIKPHSKQTRNSNHVLVGCKVYNTFFFLTFYFEIISDLKKSYRKSTKHSYMPFTQHPDFLKVHFLPYMFCPSVYPSLFSEPVESELQP

SEQ ID NO: 778269 - protein, 1057 aa, Homo sapiens
GAGNAPPAQPTPGNRGLTARMEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKALEGRDRGCLAGRGPPTRLHLKSSLTRVMGAGGVLEYPWSKRLPPSSSSSSPGFPEKIPGSQISPPEKSIRQKRSGPGLKQHTGHVCLPFEGSAKGFPSGKTGLTTNEEKPPVARRLMTLAEDWTPTRESRRGETHVENLQILVKMIARRNSGRKQTCLHYVETDQGIESSSEAFALKILSKMKIHQGGIILMKTPVFINTGSERSPGRCANPSQEVLLRVEGKTFPPGNQGLRRASEAASWPLLLCPPVPPARINVLWNKSLWLKQRAFWESSPRSGRRVPQKELRGSPTVAPLDSTSFMLLRCYPGAGPGRPGQISPAPGCGGLEGCLSRHCAIAGAGERISETTFGSNALYHVHQIVWGRGCELQQLLVPCGKVGQGGGCPPPLPPVTSCLT

SEQ ID NO: 778270 - protein, 664 aa, Homo sapiens
GAGNAPPAQPTPGNRGLTARMEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKAL

SEQ ID NO: 778271 - protein, 52 aa, Homo sapiens
EETWVAETLCGLKMKAKRRRVSLVLPEYYEAFNRLLEDPVIKRLLAWDKDLR

SEQ ID NO: 778272 - protein, 107 aa, Homo sapiens [sequence omitted]

SEQ ID NO: 778273 - protein, 91 aa, Homo sapiens
MHRSEPFLKMSLLILLFLGLAEACTPREVNLLKGIIGLMSRLSPDEILGLLSLQVLHEETSGCKEVKPFSGTTPSRKPLPKRKNTWNFPEM

SEQ ID NO: 778274 - protein, 67 aa, Homo sapiens
ADQQKALEYPPDNVHNLYFRFCSSGVACVIDRVPKEKEVIAMRSDLLLLDRRLWSVMQPEIKPQLYH

SEQ ID NO: 778275 - protein, 53 aa, Homo sapiens
MGSSEDTYVFGWLFPLGCASSGGAWGLTPLSQCLPGPVPVWRGWQGQLESLEL

SEQ ID NO: 778276 - protein, 160 aa, Homo sapiens
MPLLERFLVLLQEGEVKRPKHLHGVKPFTYLSHNLLAVFDHEKVTSPFSKEDIYAAKRHMKKCSSSLAIREMQIKTTMRYHLTPVRMAIIKKSGNKRCWRGCGEIGTLLHCWWDCKLVQPLWKSVWRFIKDLELEIPFDPAIPLLGIYPKDYKSCCYKDT

SEQ ID NO: 778277 - protein, 91 aa, Homo sapiens
YGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 778278 - protein, 48 aa, Homo sapiens
MERSTDDVEFKSGAGTELSVRGEYSVGLLCLWFVTELNNNTLHSLSND

SEQ ID NO: 778279 - protein, 179 aa, Homo sapiens
MTTSGWTAESCQTVATSQSSWATVTLGPSKLAVMSASNEEAIEKDIPSELLEDPAVTVAEDVRPGAAHLADGQACEAGATAKLEDSPGGRKGDRVCDCTRYSLLGALPCAPRSPVSEGCWVLGPFCKVEGSVPSDQACGAVEMMAVLLESVTSLRAAPKRGRESQSSNQTTVALKTVAF

SEQ ID NO: 778280 - protein, 1011 aa, Homo sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 778281 - protein, 151 aa, Homo sapiens
RPLPTVPLPLLAERAAGGLPGPEQPTGHPTAHPAPGVSSRPLYPATFRALFPDWKCFTEASWTGSPPGDKSSVLRCVTFSSPHQLWMETNKEESILLSPFSGNERRSAAGREPPLAPAAAGRGMVRRKVGKLLFPVLTAAVFVPGLQKLIQ

SEQ ID NO: 778282 - protein, 784 aa, Homo sapiens
SINYVEVQSRVVISVRGLEFSVQAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVIFIFCYHNGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 778283 - protein, 476 aa, Homo sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 778284 - protein, 1010 aa, Homo sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVIFIFCYHNGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 778285 - protein, 998 aa, Homo sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 778286 - protein, 127 aa, Homo sapiens
VCVCVWVCICVCVGTCMFGCVGVCVGVCICVCGHVCVHTCALRFRRATGGTEEENNRKKSRRKSHLKASQEFISRVKSSRSAQSLKAHLDVEEELTSGERLCPRGAVGIQRPARQSSSCDLGPWASP

SEQ ID NO: 778287 - protein, 126 aa, Homo sapiens
MPKRKPGLAIANQHLSRFLPAVNCSLAWASMPCLLLSARTWPGYSACGGIPGPEWQLGGPAVRNSKHGFGPGVPSPLPSTLLRLMIWGDASLTTATQVPAPCLLPVLLNALLGIRLKKTPGVEYSV

SEQ ID NO: 778288 - protein, 133 aa, Homo sapiens
CRNTERAGCRNTERAGCRNTERAGCRNTEGAGCRNREGRLQECTEGRLQEHREGRLQERTEGRLQERTEGRLQECTEGRLQHLRNRHGEEIPKREADKPVMASTGGFASLSWWRGLPFAGRVGGEEDPSTCLF

SEQ ID NO: 778289 - protein, 60 aa, Homo sapiens
MLAGNAQRGGEMTRMPGGQGAGPEAGRPAAAETGRLGTEPTCCPMLLTLSCAMRGYMVRL

SEQ ID NO: 778290 - protein, 280 aa, Homo sapiens
MQAKYSSTRDMLDDDGDTTMSLHSQASATTRHPEPRRTEHRAPSSTWRPVALTLLTLCLVLLIGLAAWGLLFFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 778291 - protein, 280 aa, Homo sapiens; identical to SEQ ID NO: 778290

SEQ ID NO: 778292 - protein, 250 aa, Homo sapiens
MSGVLPPQEHRAPSSTWRPVALTLLTLCLVLLIGLAAWGLLFFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 778293 - protein, 112 aa, Homo sapiens
HLSLSLLMPSANLTGPLLQPFLEVCLRRSREGISQRQHVSLRSGWKSVEAGWGRAGMGTRLQVRAFLIHAEPWALDGTTQACMLARLVQRGESSILHGTAVAFLKLTLDTRS

SEQ ID NO: 778294 - protein, 135 aa, Homo sapiens
GNYFEDPINSIIFIKGKKILEYEVLYYIFSIIITCSKLNLYNTSASEIIMTLTATVQVLLSSSELKDHVLFGDNFPPTMPYVNGCKSFICTACHDVICPLLGANANANSRTSVKQWDMGINWSYKQSLVCSYIWV

SEQ ID NO: 778295 - protein, 123 aa, Homo sapiens
GFRDRGATSASRGARGPRPPSSLLPGLPAGGACGGFRKGGLISWGHTWNRVGEFRWNRSRMGVNGPWKGAEVGGCGARDKWEGNGLSDLPWGATPRRDGLRSSAFKAIKATILLHSRKLCVGS

SEQ ID NO: 778296 - protein, 77 aa, Homo sapiens
QEAPNPLTPFQSRWRPWPPDSPSLLCAQLSGDSRAESDLGPFPEPMKRSSLGNSTHLTTSAATDASKSKPRLQPDPL

SEQ ID NO: 778297 - protein, 67 aa, Homo sapiens
EGMEKTPWDLPISLKEKDKSREQEAISRILDTLGLRWFVNKEKCFLKLADCIFHLGYDDLVSSRRKR

SEQ ID NO: 778298 - protein, 240 aa, Homo sapiens
MSPLLFGAGLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGFYQLCLSNQHNHFGSVQVYLNFGVFYEGPETDHKQKERKQLNDTLDAIEDGTQKVQNNIFHMWRYYNFARMRKMADFFLIQSNYNYVNWWSTAQSLVIILSGILQLYFLKRLFNVPTTTDTKKPRC

SEQ ID NO: 778299 - protein, 137 aa, Homo sapiens
LIGPPHPGCRADGATQGSDSEGPFSTVSRLSLGSLDLDGHVNLVPAGTRAPRLPPFHSPGFDVGKGPQGQGPRGLCTDWVWQLTPVILALGRLRWEGHLRLGVQDQAGQHSKIPLLFIYLNLFSNLKNAIKRMCIVW

SEQ ID NO: 778300 - protein, 109 aa, Homo sapiens
FFWEVFLDIGFPILIITAAAAAAKTYIECIRHHYKSLAYVNSQQFNEVDYYYSHFTDEEIVAQIYLSKSTMNIEQGQTWWVTPIIPALWEAKAGRSLEVSSSRLACTKW

SEQ ID NO: 778301 - protein, 88 aa, Homo sapiens
KGIPDSGGSWRAEGHQQALWTQPLSLDPAWPTKPRAASQGPRAGSRTSSCTLEGVRGAHCVACARWRGWRGTEGWSSGEDQQIPGHTG

SEQ ID NO: 778302 - protein, 117 aa, Homo sapiens
FKLPFGSEGAIAGRWKSRYCESRSGLLPVSSPEAKETHRCGCRYVSLLSSNGCPDPDLVLKFGPVDSTRGFLLWHIRLTEIVSLPSHVNISYGDFFSALRHYAACEQRLGKWWSLVA

SEQ ID NO: 778303 - protein, 128 aa, Homo sapiens
QAARSAVTAAALYWPNYVADGLPDFFFSSYPDSLVVGAVFLFPFYRWENEGPERLPHQNPVAEAERGWQVHRVVWLWGSEPFCIAGPLHAWLFQDRGEQRGGGRGVAEGYDCGWVLPSPSVAMGLGRV

SEQ ID NO: 778304 - protein, 102 aa, Homo sapiens
ERERWRELPGLSGGRTWGWVWGVQAMDDWSWAEATVKIPVNRAKLSLVTLTADDSTRSRLRDSVSRGKDSPAEAVALPRPPGQHSVEVEAKPMVSPLPATPC

SEQ ID NO: 778305 - protein, 77 aa, Homo sapiens
LARLREGENVRGPLRCGSASYGPPADNKAQWGLGTGGGQPCPPVLDIRRLVSGVLQPPPNPCTTGVPFLRPPKYGAS

SEQ ID NO: 778306 - protein, 101 aa, Homo sapiens
ARSEARGRGDRGCAPFSGRWDPGGGGSLWRGLLRLRWLHCMCQARVGLQGAAGAGRSSPHTSHSRQRCPLYSRQPGRRDLRVQPPECPWLFSGLSYLFKPF

SEQ ID NO: 778307 - protein, 946 aa, Homo sapiens
MSWLRITAMAPPYVATIVFTSQGAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLSLQYLDLSCNKIRYIERHTFESLPFLQYINLGCNLITELSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 778308 - protein, 126 aa, Homo sapiens
LKGEWEFRGQKIDPREYVVPTHSFQPWKNKPRVAFTPSLITRWFLFLGAVEMSWVLFGRCLLWRAGNLWSHRLCDLLFSHLLTLPQLNGLLLVFSVPPLFPHWSLCAGCFSCLEYVSLGGPSSSFT

SEQ ID NO: 778309 - protein, 116 aa, Homo sapiens
RAGFPLTQLVSMGRGRSPWRKRKNRRHGTKEAQETRGLEKEAKASRARSWWSEPKEGEPRAASVKPHKGHGGTQPELIAQPGWSGNQVNGACCRQPFSLSNTGVFPQPGKCYSIFL

SEQ ID NO: 778310 - protein, 73 aa, Homo sapiens
MSMATGKNLQSIPKKTQHYFLLCFLLKFSLTISSCLICSLKLSWAGTLPSEPLAVLTVVAPVPCRASRGGTEL

SEQ ID NO: 778311 - protein, 300 aa, Homo sapiens
PQEGEHPPNEMESKRPRLLEEADKQKKTVRVGLNAPSMLRKNQLGFLRFANYCRIARELRVSCMQRKKVQIHSWDPSSLASDRFNRILANTNTDQLFTVNQVEAGGSKYGIITMRGLTTPELRVYPHKTLYVPNRKVNSMCWASLNHLDSHLLLCFVGLADTPSCAVLLPASLFIGSFPGMRRPGMLCSFQIPDAWSCAWSLSIHAYHSFSTGLSQQVLLTNVVTGHQQSFGTSSDVLAQQFAIMTPLLFNGCRSGEIFGIDLRCGNQGSGWKAICLSHDSAVTSLQILQDGQFLVSSDM

SEQ ID NO: 778312 - protein, 102 aa, Homo sapiens
TSIQIQEIQRAPVRYFTRSSPRHIIIRFSKVIIKEKMFKAARKKSQVTHQTNSRPLRNPTSQRDWGPIFKTFFLRQCLTSVAQAAVQWHNLNSLQSQTPGLR

SEQ ID NO: 778313 - protein, 109 aa, Homo sapiens
MRPPQPCGTDPCPLCDEAKEVLKPYENRQPYKDQKLPGTRRRRSPSSPSHPHMASQSGKRYNLTLNQVLSFDYDMGLDAPKTISSDCGAFYCLRMFKSPDMTCCFYPKQ

SEQ ID NO: 778314 - protein, 115 aa, Homo sapiens
MLWFQGNSMQLARSSFGLFLRNCSASKTTLPVLTLFTKDPCPLCDEAKEVLKPYENRFILQEVNITLPENSVWYERYKFDIPVFHLNGQFLMMHRVNTSKLEKQLLKLEQQSTGG

SEQ ID NO: 778315 - protein, 278 aa, Homo sapiens
RVTSQKPTRRAVGGSWRTVPGWVLEALGPRKRLQTLQRCLAHGGCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITGSFPKKFGAIKKR

SEQ ID NO: 778316 - protein, 289 aa, Homo sapiens
RVTSQKPTRRAVGGSWRTVPGWVLEALGPRKRLQTLQRCLAHGGCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 778317 - protein, 227 aa, Homo sapiens
MLPRLVSNSGAQVIHPPQPLKMLGLQILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 778318 - protein, 246 aa, Homo sapiens
RRAARARANISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 778319 - protein, 261 aa, Homo sapiens
AGDVTKTYASRGGRELADGPWLGSGGPGTAEEASDAAAMPRPRRVSQLLDLCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVIDKVESVGLVGGTSSSLS

SEQ ID NO: 778320 - protein, 296 aa, Homo sapiens
AGDVTKTYASRGGRELADGPWLGSGGPGTAEEASDAAAMPRPRRVSQLLDLCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 778321 - protein, 365 aa, Homo sapiens
RVTSQKPTRRAVGGSWRTVPGWVLEALGPRKRLQTLQRCLAHGGSVSSWILMLRKDFISLKRNWEVTSKMAKWEQLQSAAPSKIDAEDGRFLHFQLDATGLEWLIKLHNVVGGSDFFLFRCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGKNCPFLQCVDFSATQVSDSGVIALVSGPCAKKLEEIHMGHCVNLTDGAVEAVLTYCPQIRILLFHGCPLITDHSREVLEQLVGPNKLKQVTWTVY

SEQ ID NO: 778322 - protein, 281 aa, Homo sapiens
AGDVTKTYASRGGRELADGPWLGSGGPGTAEEASDAAAMPRPRRVSQLLDLCLWCFMKNISRYLTDIKPLPPNIKDRLIKIMSMQGQITDSNISEILHPEVQTLDLRSCDISDAALLHLSNCRKLKKLNLNASKGNRVSVTSEGIKAVASSCSYLHEASLKRCCNLTDEGVVALALNCQLLKIIDLGGCLSITDVSLHALGVSDSGVIALVSGPCAKKLEEIHMGHCVNLTDGAVEAVLTYCPQIRILLFHGCPLITDHSREVLEQLVGPNKLKQVTWTVY

SEQ ID NO: 778323 - protein, 101 aa, Homo sapiens
RVTSQKPTRRAVGGSWRTVPGWVLEALGPRKRLQTLQRCLAHGGSVSSWILMLRKDFISLKRNWEVTSKMAKWEQLQSAAPSKIDAEDGRFLHFQLRCYWT

SEQ ID NO: 778324 - protein, 111 aa, Homo sapiens
MGEGGYRLTGWRDVSQAPSPLSSGAHCRLLLFPVCCETDHRPAQRSPRRVPCLCPPRRRHPPRSFTSCTFSGSRSHIHPTWRSPHDVPGSVLAPAAALGNRIGKRSPRVDA

SEQ ID NO: 778325 - protein, 111 aa, Homo sapiens; identical to SEQ ID NO: 778324

SEQ ID NO: 778326 - protein, 231 aa, Homo sapiens
EEEGEKMASMDYSTYSQAAAQQGYSAYNTQPTQGYAQTTQAYGQQSYGTYGQPIDVSYTQAQTTAIYGQTAYATSYGQPPTGYTTPTAPQAYSQPVQGYGTGAYDTTTATVTTTQASYAAQSAYGTQPAYPAYGQQPVATAPTRPQNGNKPTETSQPQSSTGGYNQPSLGYGQSNCSYPQVPGSYSMQPVTAPPSYPPTSYSSTQPTSYDQSSYSQQNTYGKPSSYGQQSS

SEQ ID NO: 778327 - protein, 113 aa, Homo sapiens
PVCEDLLFSSMQKYDLLARIVSLYRFLCIICIYPMIFIECFLCNRQNFRCLLMNDKLAISQCSSHPISQQLLTQLISPSLKNIPQLFLGNHTCSLSPCLSDCAVSVSFASSSS

SEQ ID NO: 778328 - protein, 223 aa, Homo sapiens
MTRWSSYLLGWTTFLLYSYESSGGMHEECVFPFTYKGSVYFTCTHIHSLSPWCATRAVYNGQWKYCQSEDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNKGSKENLVWCATSYNYDQDHTWVYC

SEQ ID NO: 778329 - protein, 177 aa, Homo sapiens
MTRWSSYLLGWTTFLLYSYESSGDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNKGSKENLVWCATSYNYDQDHTWVYC

SEQ ID NO: 778330 - protein, 223 aa, Homo sapiens; identical to SEQ ID NO: 778328

SEQ ID NO: 778331 - protein, 242 aa, Homo sapiens
GHVTVLRPWRARLRPYRPHRSAGHLAKTHRPQPRASPVAAARPQSHRQVQAQRGRAYGAEPLARAVGESVRPSVRPSGRRSSRQALRPRPLVSPHPEPPGGAGLAAAAMSMGLEITGTALAVLGWLGTIVCLRVAHVAVSAFIGSNIITSQNIWEGLWMNCVVQSTGQMQCKVYDSLLALPQDLQAAAPSSWWPILLGRLRGCQVALVGARATNCVQDDTGQRPRSPSWQAVLVPFLAALFT

SEQ ID NO: 778332 - protein, 93 aa, Homo sapiens
RHERTPAGPPQVHQPTRKSQRGLAGKDLSLQPPLQEEPRDPRIPDKEAGGVPCCDPETACSLTLHFHETLSLPLLQQKPSAGGERVGSVGDGL

SEQ ID NO: 778333 - protein, 119 aa, Homo sapiens
MLSYRAPCSLRIAILYSTPGCHSQAEHKTKPTALDVPVSGATTTFCWVQPHLGELGPGLGLWPRREQPDGVKLRPSVWELQWRGTEGLGVGGFGFATESQLLGQDSPREWFPWPGCQNG

SEQ ID NO: 778334 - protein, 162 aa, Homo sapiens
PSMGSLMYHKTRIITEDLPTLITFIGFLTMPVIPATREAEVGESLEPGRQMQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLK

SEQ ID NO: 778335 - protein, 283 aa, Homo sapiens
GTFAPTSPASEAGELDQQPPGASESPSPGLPRSPERWDAGLGSRQRNMAPWTLWRCCQRVVGWVPVLFITFVVVWSYYAYVVELCVYHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 778336 - protein, 170 aa, Homo sapiens
MLAGCGAQSPGHTARLHILRGPGTWVLAPPPADPALCQFRPRSWEPLFIPLCVSAGTWLGSATCCPASPGEGGARPPAARTGVAGGGAPVRKPGIRGHDGAGPRLLAAPRPPWPSAGVGQKHSTLRKGTGRARECVPGLSEQRCEDQQREEIPSSYPDGRMKTAERSSTR

SEQ ID NO: 778337 - protein, 165 aa, Homo sapiens
MGMPAICWLGAGPSRQATLHASTSSEGPGLGSWPRPLRTRHSVSSVPGPGNRSLSHSACLPEPGWEALLAALPARVRAEPGLQPRGLESREVEPQSGSRGSAAMTVPVRGFSLLRGRLGRAPALGRSTAPSVRAPGEPGSAFRGFRSSGVRPQREREKKDTNGLI

SEQ ID NO: 778338 - protein, 289 aa, Homo sapiens
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 778339 - protein, 277 aa, Homo sapiens
MGMPAICWLGAGPSRQATLHASTSSEGPGLGSWPRPLRTRHSVSSVPGPGNRSLSHSACLPEPGWEALLAALPARVRAEPGLQPRGLESREVEPQSGSRGSAAMTVPVRGFSLLRGRLGRAPALGRSTAPSVRAPGEPGSAFRGFRSSGVRTSREKRFHLPHEAIIISGTEMAKHIQKEIQRGVESWVSLGNRRPHLSIILVGDNPASHTYVRNKIRAASAVGICSELILKPKDVSQEELLDVTDQLNMDPRVSGILVQLPLPEAVQLCSGFEMLGI

SEQ ID NO: 778340 - protein, 181 aa, Homo sapiens
MGMPAICWLGAGPSRQATLHASTSSEGPGLGSWPRPLRTRHSVSSVPGPGNRSLSHSACLPEPGWEALLAALPARVRAEPGLQPRGLESREVEPQSGSRGSAAMTVPVRGFSLLRGRLGRAPALGRSTAPSVRAPGEPGSAFRGFRSSGVRTSREKRFHLPEVATVCLPTCPHPQSSFLYI

SEQ ID NO: 778341 - protein, 182 aa, Homo sapiens
MGMPAICWLGAGPSRQATLHASTSSEGPGLGSWPRPLRTRHSVSSVPGPGNRSLSHSACLPEPGWEALLAALPARVRAEPGLQPRGLESREVEPQSGSRGSAAMTVPVRGFSLLRGRLGRAPALGRSTAPSVRAPGEPGSAFRGFRSSGVRYEGCGRRVRSRWRWEVGGGAGGARARGAQGS

SEQ ID NO: 778342 - protein, 450 aa, Homo sapiens
MGMPAICWLGAGPSRQATLHASTSSEGPGLGSWPRPLRTRHSVSSVPGPGNRSLSHSACLPEPGWEALLAALPARVRAEPGLQPRGLESREVEPQSGSRGSAAMTVPVRGFSLLRGRLGRAPALGRSTAPSVRAPGEPGSAFRGFRSSGVRHEAIIISGTEMAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 778343 - protein, 106 aa, Homo sapiens
MAKHIQKEIQRGVESWVSLGNRRPHLSIILVGDNPASHTYVRNKIRAASAVGICSELILKPKDVSQEELLDVTDQLNMDPRVSGILVQLPLPEAVQLCSGFEMLGI

SEQ ID NO: 778344 - protein, 1193 aa, Homo sapiens
MCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKETTEQRAEELESRVSSSGLDSLGRYRSSCSLPPSLTTSTLASPSPPSSGHSTPRLAPPSPAREGTDKANHVPKEEAGAPRGEGPAIPGDTPPPTPRSARLERMTQALALQAGSLEDGGPPRGSEGTPDSLHKAPKKKSIKSSIGRLFGKKEKGRMGPPGRDSSSLAGTPSDETLATDPLGLAKLTGPGDKDRRNKRKHELLEEACRQGLPFAAWDGPTVVSWLELWVGMPAWYVAACRANVKSGAIMANLSDTEIQREIGISNPLHRLKLRLAIQEMVSLTSPSAPASSRTSTGNVWMTHEEMESLTATTKPETKEISWEQILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 778345 - protein, 141 aa, Homo sapiens
MRGEAAPSPFSCPVAGPKSSFFVRKEGRGDSLLQASPPVPLSSAPPRPVAGPPGHLRAGSPLPPPCLVSPGPHRPPCCGRVRAPGVGGAEWRFPFSSGSGVCMGESSFHDAAGRRGVGAGGRWGSPRPRLSVGLPAPGVTQ

SEQ ID NO: 778346 - protein, 120 aa, Homo sapiens
MGLCATQLRPAASGRRSPGSSAGGVPSPSPVSRVPGASPPPVLWPCPCPGGRGRRMALPLLLWLRGLHGRILFPRCRWATWRGGRGTVGEPSPPTLGRPPRPRRHSVITGKENCFKKLTC

SEQ ID NO: 778347 - protein, 1053 aa, Homo sapiens [sequence omitted]

SEQ ID NO: 778348 - protein, 1053 aa, Homo sapiens [sequence omitted]

SEQ ID NO: 778349 - protein, 1062 aa, Homo sapiens
MTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKETTEQRAEELESRVSSSGLDSLGRYRSSCSLPPSLTTSTLASPSPPSSGHSTPRLAPPSPAREGTDKANHVPKEEAGAPRGEGPAIPGDTPPPTPRSARLERMTQALALQAGSLEDGGPPRGSEGTPDSLHKAPKKKSIKSSIGRLFGKKEKGRMGPPGRDSSSLAGTPSDETLATDPLGLAKLTGPGDKDRRNKRKHELLEEACRQGLPFAAWDGPTVVSWLELWVGMPAWYVAACRANVKSGAIMANLSDTEIQREIGISNPLHRLKLRLAIQEMVSLTSPSAPASSRTSTGNVWMTHEEMESLTATTKPETKEISWEQILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 778350 - protein, 141 aa, Homo sapiens; identical to SEQ ID NO: 778345

SEQ ID NO: 778351 - protein, 1053 aa, Homo sapiens [sequence omitted]

SEQ ID NO: 778352 - protein, 499 aa, Homo sapiens
MTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKCAWCGNP

SEQ ID NO: 778353 - protein, 170 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQVSWGKMGQSRWSPA

SEQ ID NO: 778354 - protein, 605 aa, Homo sapiens
MHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASGIPEQDGTVDSTQAPAERAGTGEVPGPIASCQDLGVSVDVFVDPPGYQCPGALLANASCLALVLWNSPLAQTWHFLATSGRFSSPVAVLRRRVGASWPQASFFVPIAPNPCGTRTTSGKRLPSLPLTGHESRLLASLQPLCHSQTCLSLPDPFPWQPTDRPAEFWATQPSWLGKGWPPGPEDSECTATGPVSQEAGQLLSCPTAPGWPSAPLYSATSVQPSGAPVESRSTSLLQPLPASAGASCSRCLWAPQPLQVPCLPVSQPWSQPQPQPQPHAGRELLLRVPKVLWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778355 - protein, 537 aa, Homo sapiens
MKADASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASGIPEQDGTVDSTQAPAERAGTGEVPGPIASCQDLGVSVDVFVDPPGYQCPGALLANASCLALVLWNSPLAQTWHFLATSGRFSSPVAVLRRRVGASWPQASFFVPIAPNPCGTRTTSGKRLPSLPLTGHESRLLASLQPLCHSQTCLSLPDPFPWQPTDRPAEFWATQPSWLGKGWPPGPEDSECTATGPVSQEAGQLLSCPTAPGWPSAPLYSATSVQPSGAPVESRSTSLLQPLPASAGASCSRCLWAPQPLQVPCLPVSQPWSQPQPQPQPHAGRELLLRVPKVLWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778356 - protein, 605 aa, Homo sapiens; identical to SEQ ID NO: 778354

SEQ ID NO: 778357 - protein, 219 aa, Homo sapiens
MAESRLRAPDLGVSRCLGKCQKNSPGARKHPFSGKSFYLDLPAGKNLQFLTGAIQQLGGVIEGFLSKEVSYIVSTSPGALSPCLPALVPTPAPAPAPCWQRAAPTSPQGAWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778358 - protein, 605 aa, Homo sapiens; identical to SEQ ID NO: 778354

SEQ ID NO: 778359 - protein, 187 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEW

SEQ ID NO: 778360 - protein, 410 aa, Homo sapiens
MKADASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASGHESRLLASLQPLCHSQTCLSLPDPFPWQPTDRPAEFWATQPSWLGKGWPPGPEDSECTATGPVSQEAGQLLSCPTAPGWPSAPLYSATSVQPSGAPVESRSTSLLQPLPASAGASCSRCLWAPQPLQVPCLPVSQPWSQPQPQPQPHAGRELLLRVPKVLWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778361 - protein, 764 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQNMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASGIPEQDGTVDSTQAPAERAGTGEVPGPIASCQDLGVSVDVFVDPPGYQCPGALLANASCLALVLWNSPLAQTWHFLATSGRFSSPVAVLRRRVGASWPQASFFVPIAPNPCGTRTTSGKRLPSLPLTGHESRLLASLQPLCHSQTCLSLPDPFPWQPTDRPAEFWATQPSWLGKGWPPGPEDSECTATGPVSQEAGQLLSCPTAPGWPSAPLYSATSVQPSGAPVESRSTSLLQPLPASAGASCSRCLWAPQPLQVPCLPVSQPWSQPQPQPQPHAGRELLLRVPKVLWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778362 - protein, 802 aa, Homo sapiens
MVRSRGGGFRNVTSRGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASGIPEQDGTVDSTQAPAERAGTGEVPGPIASCQDLGVSVDVFVDPPGYQCPGALLANASCLALVLWNSPLAQTWHFLATSGRFSSPVAVLRRRVGASWPQASFFVPIAPNPCGTRTTSGKRLPSLPLTGHESRLLASLQPLCHSQTCLSLPDPFPWQPTDRPAEFWATQPSWLGKGWPPGPEDSECTATGPVSQEAGQLLSCPTAPGWPSAPLYSATSVQPSGAPVESRSTSLLQPLPASAGASCSRCLWAPQPLQVPCLPVSQPWSQPQPQPQPHAGRELLLRVPKVLWLFTGPGSSRLKGHRYNLLLCWVLHTRPGLTRTQEGQNPRTSPKELEGGPGLAFEVQQAAVTLSSMELTEPPLPLARSLGENLGWGLPSPTPASCHVPDQAESTVGLPS

SEQ ID NO: 778363 - protein, 179 aa, Homo sapiens
GYCECCQEAFEELHVVSPFPIKQLLPECPEGACSLGMSPSYAISMLLWLSSRARAWAGRSASVSPSPQASSNALCSSPPPAASSECPAPELCPGSPSICRSGQDHCSAQPQLCRHPFPGWPPQVSATLAGTTVSALSSVALWVGRDPQVGGCWDQTVMFSSFLTFLSPYPQSCLFWGWP

SEQ ID NO: 778364 - protein, 150 aa, Homo sapiens
MSGDVAEVSRAARLLHGSRGTGTGSSAALWAAGRAATSESRMGLPRSGRAPLGSAEGVCRARDLEPGPDPSWLLSGLLPLPPFHPSPAGCPAGPSAAVAFSELRLRRRCHSCLQPRRAGQVMQRVPRDLPPPPTPFSPGSTPQFPPLRVS

SEQ ID NO: 778365 - protein, 30 aa, Homo sapiens
FNPDVCWDRNNPEPWNKLGPNDQYKFCSVN

SEQ ID NO: 778366 - protein, 71 aa, Homo sapiens
MTSVPLGTRSQFRYDSVSPKACDSNFSSIEISGPLETTHPSKPCAPGGNPALQAVTQGGFQSSGEKSAMWC

SEQ ID NO: 778367 - protein, 116 aa, Homo sapiens
MVQRREFHPGVNLPGLPCALQESRSETHAGVWWWACGSGHRLGLHRTHVVPARVLWAQKRPCLRASRTRQSWALRALGPVSVCREPPVATRISPREDSGRDRGRPPGGPWTAAGAP

SEQ ID NO: 778368 - protein, 107 aa, Homo sapiens
PPCHDPIPGRPPPTSAASHTLLPQPSAFSAEPTHQVCAYLRLAVPEDPHPRRFQAKTLSHPLRLCTAIGASPHRGKGLNEFTHSIARYPAFTRLYRLMGYKDEQSLH

SEQ ID NO: 778369 - protein, 173 aa, Homo sapiens
MISKPCKSKGKEHSAKQRRPHNSLSSNFTTRFQPHRNTTEERATEPELGRGWAHMHRGRPTCTAGGAHGTLVTSSPGSRAGEGRREERGEEAQDPGTSPGSPGGEGRREERGEEAQDPGTSPGSPGGEGRREERGEEAQDPGTSPGSPAGKGRREERGEEAQDPGTTGARVDT

SEQ ID NO: 778370 - protein, 269 aa, Homo sapiens
AAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGT

SEQ ID NO: 778371 - protein, 41 aa, Homo sapiens
MGNVPPKAETPLRCILENWDQLDSHMLRNKRLIFFCSTTWP

SEQ ID NO: 778372 - protein, 103 aa, Homo sapiens
QDYADMAVRRQDKLADSCSFLSLNNSSHSFLKALPFSCSPSVGVFVYTSLARKALLSGFPLPPPLLPALSPAFPSSFLLSLPPFLPVPFFPSLCPSPFLPLLM

SEQ ID NO: 778373 - protein, 113 aa, Homo sapiens
AFSSVFRAGLPAASAPEGPVGGGAQILRALPQGSHVGHCENPVSPSPRFVLALEAGPVTPFCRLRRRSGSWVLCAKPGSEDRSPAVWPSSKPRGASRDHTGLSPCTSVSQELI

SEQ ID NO: 778374 - protein, 142 aa, Homo sapiens
MEELDRQKIGGFWREVGVASDQSLVLTAPKRVEGLFLTLSGSNLTVKVAYNSSGSCEIEKIVGSEIDSTGKFAFPGKCSCPVMAGGTRLCTQLGLIVPHAVPCTVPHAVPCTVLCAVPCTGPQCCSLNYSLCCSPCCSLHCS

SEQ ID NO: 778375 - protein, 152 aa, Homo sapiens
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 778376 - protein, 182 aa, Homo sapiens
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFSKLGPGGLCPAAALPGTARPAPLCPTARSLEDKDRLGFWKFRELTADTGLYLAARPGEPRGLGVEAGLGPVG

SEQ ID NO: 778377 - protein, 133 aa, Homo sapiens
GTLLPFSSGSCEIEKIVGSEIDSTGKFAFPGHREIHVLDTDYEGYAILRVSLMWRGRNFRVLKYFSKLGPGGLCPAAALPGTARPAPLCPTARSLEDKDRLGFWKFRELTADTGLYLAARPGRCAELLKEELI

SEQ ID NO: 778378 - protein, 134 aa, Homo sapiens
MELDPADPGFEVRPPQTSPPTPWPALEGHREIHVLDTDYEGYAILRVSLMWRGRNFRVLKYFSKLGPGGLCPAAALPGTARPAPLCPTARSLEDKDRLGFWKFRELTADTGLYLAARPGEPRGLGVEAGLGPVG

SEQ ID NO: 778379 - protein, 114 aa, Homo sapiens
ACRYFDEGHGSCPFGGNGFYKHVYPDGRREEPQRQKVGTSSRYPAQGRNHFWELIEERENSSPFDNDEEEVVTFELGELLLMLLAAVGDDELTDSEDESDLFHEELEDFYDLDL

SEQ ID NO: 778380 - protein, 118 aa, Homo sapiens
FIDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINN

SEQ ID NO: 778381 - protein, 142 aa, Homo sapiens
PGVVSLGVLALWAGVGTWGGVRWGRRTSSLQAARAGLEGSGLQSQRPHTASVQSFAHRSPTPPAAARDRRRSLGNSGRRANSGALKCPLPPRGTSWITWRRCHFLYPVPQAFSLFNSVCPGLPLGSFSLSWDLIKRLLFFFF

SEQ ID NO: 778382 - protein, 187 aa, Homo sapiens
LNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRTNNGDKEVGNKEDAETGNVAYIYLLIQ

SEQ ID NO: 778383 - protein, 313 aa, Homo sapiens
MMGSWKHCLFSASLISALIFVFVYNTELWENKRFLRAALSNASLLAEACHQIFEGKVFYPTENALKTTLDEATCYEYMVRSHYVTETLSEEEAGFPLAYTVTIHKDFGTFERLFRAIYMPQNVYCVHLDQKATDAFKGAVKQLLSCFPNAFLASKKESVVYGGISRLQADLNCLEDLVASEVPWKYVINTCGQDFPLKTNREIVQYLKGFKGKNITPGVLPPDHAVGRTKYVHQELLNHKNSYVIKTTKLKTPPPHDMVIYFGTAYVALTRDFANFVLQDQLALDLLSWSKDTYSPDEHFWVTLNRIPGMYVS

SEQ ID NO: 778384 - protein, 313 aa, Homo sapiens; identical to SEQ ID NO: 778383

SEQ ID NO: 778385 - protein, 313 aa, Homo sapiens; identical to SEQ ID NO: 778383

SEQ ID NO: 778386 - protein, 205 aa, Homo sapiens
MMGSWKHCLFSASLISALIFVFVYNTELWENKRFLRAALSNASLLAEACHQIFEGKVFYPTENALKTTLDEATCYEYMVRSHYVTETLSEEEAGFPLAYTVTIHKDFGTFERLFRAIYMPQNVYCVHLDQKATDAFKGAVKQLLSCFPNAFLASKKESVVYGGISRLQADLNCLEDLVASEVPWKYVINTCGQDFPSRFVFSCIN

SEQ ID NO: 778387 - protein, 104 aa, Homo sapiens
SERFLLRRLVWLGRLAGRKVTKEQRSVGFAVASVPSSISCLQAGLPQRFSCLDQLVSKLLRSFLGQRPGCPENVASLETFSHELVFSGLSLQRSGLCARCCHLL

SEQ ID NO: 778388 - protein, 1386 aa, Homo sapiens [sequence omitted]

SEQ ID NO: 778389 - protein, 1412 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGEVRVCGGRGGPRWSSGPDSILFSHSGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHKSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPAARRLSYATTVNIHVGGGGRLRPAKAQVRLNHPALLASTQESMGLHRAQGAPDAPFHM

SEQ ID NO: 778390 - protein, 104 aa, Homo sapiens
QGCRSRVCRAGFRPDSELLMPVVLDILLVPLQFGVYRRVLHGSSYPIRARARSPLCWVSVPLLQRSSPPGCSAWPLPLGAWEWILEWIPGPLHLHLPQALELVP

SEQ ID NO: 778391 - protein, 58 aa, Homo sapiens
APSLITEFLTFSASSSPSSNQPAQSPQASLPAQPPTSSHMCNLVQMNKHSLGEERMPQ

SEQ ID NO: 778392 - protein, 39 aa, Homo sapiens
MDCMFTSPQNSQEILLSNAMIFGDGTFGRSLGSGEVMRV

SEQ ID NO: 778393 - protein, 308 aa, Homo sapiens
MAEPGHSHHLSARVRGRTERRIPRLWRLLLWAGTAFQVTQGTGPELHACKESEYHYEYTACDSTGSRWRVAVPHTPGLCTSLPDPVKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSC

SEQ ID NO: 778394 - protein, 143 aa, Homo sapiens
SDASVPSPAHIEKLDNEKLNPTRATATVASVSHPQGPSSCRQEKAPSPTGPALISGASPVHCAADGTVELKAGPSKNIPNPSASSKTDASVPVAVTPSPLTSWVAYTSECFPCKPGTYADKQGSSFCKLCPANSYSNKGETSC

SEQ ID NO: 778395 - protein, 400 aa, Homo sapiens
PAGELQRRAWSLPHPRGAREEAVVKATWVGGEDRGRRKDGRCWRSRREVTEASLASCILRLCTSLPFFSAFCQQEAAAAAPEPLLPLTQDNAMAEPGHSHHLSARVRGRTERRIPRLWRLLLWAGTAFQVTQGTGPELHACKESEYHYEYTACDSTGSRWRVAVPHTPGLCTSLPDPVKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSC

SEQ ID NO: 778396 - protein, 397 aa, Homo sapiens
PWWLVPCLFSRESRPHPVFMYGRPQAEMEQEAGELSRWQAAHQAAQDNENSAPILNMSSSSGSSGVHTSWNQGLPTIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNN

SEQ ID NO: 778397 - protein, 239 aa, Homo sapiens
PWWLVPCLFSRESRPHPVFMYGRPQAEMEQEAGELSRWQAAHQAAQDNENSAPILNMSSSSGSSGVHTSWNQGLPTIQHFPHSAEMLGSPLVSVEAPGQNVNEGGPQFSMPLPERARTCSTDSREELQASGRDCRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNN

SEQ ID NO: 778398 - protein, 184 aa, Homo sapiens
MVRYSLDPENPMKSCKSRGSNLRVHFKDTRETAQAIKGMHIRKATKYLKDVTLQKQCIPFRRYNGGVGKCAQAKQWGWTQGRWPKKSAEFLLHMFKNAEGNTELKGLDVDSLVIEYIQVNKAPKMLRRTYRAHGRINSYMSSPWHIEMILTEKEQIVPKPEKEVAQKKKISQKKLKKQKLMARK

SEQ ID NO: 778399 - protein, 438 aa, Homo sapiens
GVTVMLRRGHLAFRDVAIEFPQEEWKCLDPAQRTLYREVMVENYRNLVFLGICLPDLSVISMLEQRRDPRNLQSEVKIANNPGGRECIKGVNAESSSKLGSNAGNKSLKNQLGLTFQLHLSELQLFQAERNISGCKHVEKPINNNSLVSPLQKIYSSVKSHILNKYRNDFDDSPFLPQEQKAQIREKPCECNEHGKAFRVSSSLANNQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRIHTGEKPYECKECGKVFRHKFCLTNHHRMHTGEQPYKCNECGRPRRVDHEVRRSRPSWLTR

SEQ ID NO: 778400 - protein, 353 aa, Homo sapiens
MICLVQESMVSTDLDASAMSVSEIMITPAWVKQETHEAEIRVVGVHVGRLLVSIEEVVHAELDINLRVGLKRDPRNLQSEVKIANNPGGRECIKGVNAESSSKLGSNAGNKSLKNQLGLTFQLHLSELQLFQAERNISGCKHVEKPINNNSLVSPLQKIYSSVKSHILNKYRNDFDDSPFLPQEQKAQIREKPCECNEHGKAFRVSSSLANNQVIHTADNPYKCNDVTRSSVTVQTLYNIKEFILERSLTSVMNVASSSIEFHSLHDIREYILERNLTNVMSVAKSSLKILTLQIITESTLERNLTNVMSVARSSTEMHTLHDIRKFIVERNLTNVRNVAKHFQGVQALLLIL

SEQ ID NO: 778401 - protein, 101 aa, Homo sapiens
PGEQRGAGGRGGVGGGVSLRRCGSKACWPEVTPGMCPVWDRAGCREERGSGCGGGGLLASCHRTLLPQERGNEWESSGRVCPLPQTPLSLWHEKGGIWLTR

SEQ ID NO: 778402 - protein, 118 aa, Homo sapiens
LTTGEGETIQALSNCHPKVGTKGELSVTGAQEAGLFIGICRSWGYGGGAATGPEPLPRAEKEEKCPGVASLPALLSPPSAFHWPNPPRSQFPSKEALKRWFGRIYPVTEGRVEEGHLD

SEQ ID NO: 778403 - protein, 197 aa, Homo sapiens
VAILWALSPLPVTLWHSSVQDNYSLETMAVKFHFYFKLCPLLLYKIGHKFPKEEKFIVKTESMYKIRQWEERKEPETGHSESWKGLENHSLTWLGLGRLIGSHVWKGPWRVYCPGQVQVGLPLSVQAPTLGQAQVSRTPRTLWTALRYVWAALSTVNTINLNFCTMLSLNSQRGRSLAAKSPAVPLPHSGTSKPLCP

SEQ ID NO: 778404 - protein, 60 aa, Homo sapiens
VPWLEASQGPQGFLSGCQSKWWLPLALRGSVAQLPPGPPAAQAAQPALLGAFRGCALAAV

SEQ ID NO: 778405 - protein, 86 aa, Homo sapiens
HLRVCAFFIGVNAESHAIKRVVPPQHSQSQPGHRQICYLPRKLHLVTSTLNYPQNSARNHRWRRASYLLKVKPILLARFPYCKTFL

SEQ ID NO: 778406 - protein, 423 aa, Homo sapiens
FKTGKEEDEARSRRVTKVDFQQRCPAEHFPALFFSSFEEKYSDPYVKLSLYVADENRELAVVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVTYRWRIYSAGSAPTTGLPRISDQPSGAVRGTKQKASDHSRLQWGTVQLFDSKRTLLKVEVMQCHRRSCRTGTIYHCQCPSWESAFIKLSRVVRNQRHQWPMYIPRRVCLQAGTEDKMLGAHILCHHNNRTKWTRPIMQLQKI

SEQ ID NO: 778407 - protein, 110 aa, Homo sapiens
WIAPLCIMIGLPQMVSVRDVCWRTLATESLNWVGRICPPCGQAPSSQPGAWKKGESWLSVPELGCSSPALGCQNSRFSGLWTLGLVRVVSGVFDLGLGMTTFPTILKQLT

SEQ ID NO: 778408 - protein, 121 aa, Homo sapiens
MLAPGHPTWIPWISPTPLLYNAPERLTPPPWPCLSSQPHKIFFSTSVSYLNQYFKLPTHFGQKPELPLSLSTTSPLHHINHKSHVLSFLGVLVFRRFLCNAACLASATTMAPYCTHVHSAA

SEQ ID NO: 778409 - protein, 67 aa, Homo sapiens
LEHQTPSSSAFGLSHLDQWFARGSRAFGHRLKDTLSASLLLGFWDWDWFPSSSACRQPIMGFHLVIV

SEQ ID NO: 778410 - protein, 106 aa, Homo sapiens
MATCVYTVGYAGTVSLLAALCPKVTLAPLLPFSLGCILLLLLAGFLQHHEVLRVLCPEVRAPATEIVKRRLWVSVVTSTTLGQKPIPSPQRGKSLPFSINIAHQCL

SEQ ID NO: 778411 - protein, 146 aa, Homo sapiens
MFSRPFRKHGVVPLAMYMRICKKGEIVDIKGTGTVQKGMPHKCYHGKTGKVYNVTQHAVGIAVNKFKGKILAKRINVRIEHIKHSKSQDSFLKRVKENDQKKKEAKEKGTWVQLKHQPAPPREAHFVRTNGKEPEQLEPIPYEFMA

SEQ ID NO: 778412 - protein, 126 aa, Homo sapiens
MRKERKTVSESKDIENKEEKERKYTSGTHLIGPMNCSKIVLHKKDNLLYIILLDNKIIGGPIQENRWYVCCLSPIAFFFFEMESCSIVQAGVQWHNLSSPQATPPRFKPFSGLSLPSSWDYRRAPP

SEQ ID NO: 778413 - protein, 107 aa, Homo sapiens
SPSSAPKAQGLLLVLLHPPLEPGIVSLPQGQTPQNARQTALSLSRDIESAMSPGNSTTNHNLWNRAGHTEDSAAISSPRAGVGGYSQVIALCQGPGCSIQRPASGQS

SEQ ID NO: 778414 - protein, 36 aa, Homo sapiens
CDLIGSRSNLLQSLGWVPRTKLHTRAKAGLGCSTRT

SEQ ID NO: 778415 - protein, 114 aa, Homo sapiens
MLSSSAVSSSSEEPARCGLEGTGNPQGHPEALIFVSHGAGEHSGRYEELARMLMGLDLLVFAHDHEALIFVSHGAGEHSGRYEELARMLMGLDLLVFAHDHGECPRVPSELAGP

SEQ ID NO: 778416 - protein, 313 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778417 - protein, 303 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778418 - protein, 313 aa, Homo sapiens; identical to SEQ ID NO: 778416

SEQ ID NO: 778419 - protein, 313 aa, Homo sapiens; identical to SEQ ID NO: 778416

SEQ ID NO: 778420 - protein, 313 aa, Homo sapiens; identical to SEQ ID NO: 778416

SEQ ID NO: 778421 - protein, 313 aa, Homo sapiens; identical to SEQ ID NO: 778416

SEQ ID NO: 778422 - protein, 277 aa, Homo sapiens
MQTRFRRIFPWKDASTKRMPEFIHFSPLKPYKGREWEKAGSEHVLETHLLPVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778423 - protein, 277 aa, Homo sapiens; identical to SEQ ID NO: 778422

SEQ ID NO: 778424 - protein, 240 aa, Homo sapiens
MLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778425 - protein, 339 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKDYSRILKHLMEKASRMLKFWIPRPFWVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778426 - protein, 329 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKDYSRILKHLMEKASRMLKFWIPRPFWVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778427 - protein, 283 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778428 - protein, 145 aa, Homo sapiens
MKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778429 - protein, 313 aa, Homo sapiens; identical to SEQ ID NO: 778416

SEQ ID NO: 778430 - protein, 131 aa, Homo sapiens
LRKIENKDRERAAGGGFEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 778431 - protein, 272 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKDYSRILKHLMEKASRMLKFWIPRPFWVSNSPLRLPWCAHSSGWRLWESRSSSHLVDLDNVIHLGAGPAMTPSFPTASSSCRLNGPCSTVLLSFMHNQPTSSA

SEQ ID NO: 778432 - protein, 313 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLLLTGHGGLYCLCEVSPRSLQQTLSDTVRVPTRYSNRRVRIITTRYRNKQWVSKQAENSVPHIVDAPMSVKLG

SEQ ID NO: 778433 - protein, 313 aa, Homo sapiens; identical to SEQ ID NO: 778416

SEQ ID NO: 778434 - protein, 313 aa, Homo sapiens; identical to SEQ ID NO: 778416

SEQ ID NO: 778435 - protein, 313 aa, Homo sapiens; identical to SEQ ID NO: 778416

SEQ ID NO: 778436 - protein, 313 aa, Homo sapiens; identical to SEQ ID NO: 778416

SEQ ID NO: 778437 - protein, 277 aa, Homo sapiens; identical to SEQ ID NO: 778422

SEQ ID NO: 778438 - protein, 240 aa, Homo sapiens; identical to SEQ ID NO: 778424

SEQ ID NO: 778439 - protein, 313 aa, Homo sapiens; identical to SEQ ID NO: 778416

SEQ ID NO: 778440 - protein, 313 aa, Homo sapiens; identical to SEQ ID NO: 778416

SEQ ID NO: 778441 - protein, 241 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEIYEGAYHVLHKELPEVTNSVFHEINMWVSQRTATAGTASPP

SEQ ID NO: 778442 - protein, 93 aa, Homo sapiens
GLEAPPALPQATAGQAGTGLTQGPRSGHSANAFQKTEALGLDLPFSGANNHPSPALGLHFFPAISGVHHPPREYFPLLNGTCCYLREASLVQI

SEQ ID NO: 778443 - protein, 106 aa, Homo sapiens
QLRLGTRPGCDQSFRAEALGLACPSQVPIPPQPCPWPHFFPAISGVHHPPREYFPLLNGTCCYLRRLLSANMTLVRALPPLKPCRRCNVGVLGPQRRGHFPPGPPT

SEQ ID NO: 778444 - protein, 112 aa, Homo sapiens
VSTVGSVWREGFSSIHSGMCVSRRILQCPRRDVCVSRRILQSPRRDVCGEKDSPVSTAGCVWREGFSGVHGRTCVARRILQCPRRDVCGDGFSSVHSRTCMARRILRCPRWD

SEQ ID NO: 778445 - protein, 122 aa, Homo sapiens
TSNFMPLSSDLVPLSLFQIQGPSCFPSSRHTLFSFSLHKFQLFHQQTQAVQGRKCPTGPEADQFGKETNQKLSISCLGSVFLFLFFLKQSLTLSPRLECNGMILAQSNLRLPGSSDPPASAS

SEQ ID NO: 778446 - protein, 105 aa, Homo sapiens
DVIPTFYCILWVGSEQETKTLRKLETRKTLESQLYAFFNMVSDFFSPTHFPLSQSKFYPDVNMKRPVFVHSLLLWFSFVPQKVLVLCFKTQVMKGKQLGYSGETA

SEQ ID NO: 778447 - protein, 31 aa, Homo sapiens
MFSSIPGLYLLASLLEPIPLSFTPVPPPWCF

SEQ ID NO: 778448 - protein, 245 aa, Homo sapiens
SGFSTCAGLNGLQEHSRPEELMVTHRREPKKLALLRLETLRLGPRDRSAVSEGSGDPASPGLFPWRRRLLPWDNMFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETE

SEQ ID NO: 778449 - protein, 149 aa, Homo sapiens
VGCRFHRVAQAGLKLLTSSDPSASASPGAGITGMSHRTQRGQDNFASWRRGGPQMSPSPPSCLFLQNTFSLKPSWVAPYPHASALGCGECGGPPCSSAPFGVMSCAAELTTPPPPVPPPGVTGNCSLPGPAPTQLPYPWAPASASSHVD

SEQ ID NO: 778450 - protein, 116 aa, Homo sapiens
KRMKLHWQFSQGGPIQNRKSKRCLELQENSDLEFGFQLVLQKCSGQHWSITNVLEEPRVLTHRGHFRLPLCYCVAPAATLPAVHVGLFGVWGTRLVGPQEELFISYSIFMEFIERC

SEQ ID NO: 778451 - protein, 118 aa, Homo sapiens
WTVDPSKADSPSGSASVFRTWYVMDLRELSLPAASHSSHSLPLFSTQYFPKPILVKETNGLYILKSEMKFSVFILTTLSAASDTASHLLLLGTLSHVAFGTPVPLGSPCVSSDAFSLL

SEQ ID NO: 778452 - protein, 104 aa, Homo sapiens
MLPLINSFFQQGFSKRLLHKATVLGKEGSGMSSTGGEISVALMWAPLERHALERDGVAMASSSVGSHSAGARPKSAPVKLSAIPSVPSASWAAALRRGKTHPNF

SEQ ID NO: 778453 - protein, 70 aa, Homo sapiens
TSVKAGPWLLTGHSQPLPMAGNPDLKGEQEAKKANWEGGGPVAHLLALGWMSEQEAAASSGQVEEGQAGS

SEQ ID NO: 778454 - protein, 40 aa, Homo sapiens
LPIIYILLYENPKGAHLHMPLYSSPSPSSDKSLVAQQSPQ

SEQ ID NO: 778455 - protein, 119 aa, Homo sapiens
LSQALGRQRGRESFFVPTPCCLADERSYQGLGLSAGVKVRVPRSASTHLAFLFLAPSWPKYFSIVALITLTEVSFPRPFEEQNSHTLLSLNPLSPASSGLPLSMGHLELVSTAEQTRNK

SEQ ID NO: 778456 - protein, 310 aa, Homo sapiens
AAQRAQRSAGSAGGGGTRFPGLQRSAQRSSLRRWQLRRRRRGDAVGLVGRRCPGLFLRTKNKLNSSQNDYKSSRRSSLPPELLIGNDIRGRLQRNIKNLDPIHLRHPKKRPSIFPGRKHTLSLGVLRPPDSCSLVAASLAGVRKMATNFLVGEKIWFHKFKYGDAERRFYEQMNGPVAGASLQEASMILHDIARARENIPKSLAGSLGPGASSGPSGDHSELVVRIASLEVDNQRDLAERAGEELARPLGHSPADPAHVSHAPSGAPGKKLATPAEDDEDDDIDLFGSDNEATQLRHYHEERLQQYAEKK

SEQ ID NO: 778457 - protein, 166 aa, Homo sapiens
MATNFLVGEKIWFHKFKYGDAERRFYEQMNGPVAGASLQEASMILHDIARARENIPKSLAGSLGPGASSGPSGDHSELVVRIASLEVDNQRDLAERAGEELARPLGHSPADPAHVSHAPSGAPGKKLATPAEDDEDDDIDLFGSDNEATQLRHYHEERLQQYAEKK

SEQ ID NO: 778458 - protein, 176 aa, Homo sapiens
KRTPAQPQDMIMRKPHHLDKILATPSRTLDVPISTHSLTPQSQTSTKFHHLHPLRALTSVLQAKFWPLPSHLDHHIWYPGLQFPSHTGLTLTDASHSCVECNFSTMHNILPAPFTLRTKSEFLSLEFEALCEVAQPLPHLTSHSCAPSTHGISQPPGQTLNLHSSTRKGLCVFLAL

SEQ ID NO: 778459 - protein, 43 aa, Homo sapiens
KLTVSKTDIPGNNCKHKIFRYNDNIRKGSYIGWMQWLMPKIPA

SEQ ID NO: 778460 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 778461 - protein, 497 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQVGGHHHDAIVTSYDWFERVELRDVTRKGRGHRNISFPCDGSLLANIKEPEGGGDGRAPRQMAVLVAATPSCRLVALQTTRNGVRLCLSGFQALDVPPPAGPFWILGDVFLGTYVAVFDRGDMKSSARVGLARARTRGADLGWGETAQAQFPG

SEQ ID NO: 778462 - protein, 398 aa, Homo sapiens
MRPQDTWVHTQVPSDVSTTAAATPAAAAASAECGAFRGHTDPPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 778463 - protein, 523 aa, Homo sapiens
MRPQDTWVHTQVPSDVSTTAAATPAAAAASAECGAFRGHTDPHPSSSSPTWTQDPEPTEGMERTSRAPQVGGPIPWGQAHLRTSLELQGCESQPHTALTPAPLSQTLRLLSSFAIRCSILGKLGWERLHKTSLLPLTLAPPISGSRPGDATSSVCPAVSFYVGELRLNGGEGRRRGWTSASQRLLRNCSFIMPSQVRKSKGQRHWGDSLPHDTFLTSNLGLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 778464 - protein, 139 aa, Homo sapiens
MTVERVELRDVTRKGRGHRNISFPCDGSLLANIKEPEGGGDGRAPRQMAVLVAATPSCRLVALQTTRNGVRLCLSGFQALDVPPPAGPFWILGDVFLGTYVAVFDRGDMKSSARVGLARARTRGADLGWGETAQAQFPG

SEQ ID NO: 778465 - protein, 420 aa, Homo sapiens; identical to SEQ ID NO: 778460

SEQ ID NO: 778466 - protein, 387 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGETTRNGVRLCLSGFQALDVPPPAGPFWILGDVFLGTYVAVFDRGDMKSSARVGLARARTRGADLGWGETAQAQFPG

SEQ ID NO: 778467 - protein, 411 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCSSSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 778468 - protein, 393 aa, Homo sapiens
MRPQDTWVHTQVPSDVSTTAAATPAAAAASAECGAFRGHTDPHPSSSSPTWTQDPEPTEGMERTSRAPQVGGPIPWGQAHLRTSLELQGWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 778469 - protein, 100 aa, Homo sapiens
GGSWAPPCVSFWAVELSALKPEEVVVQGGVALAPRPLGTSFRFESHLMEGGIGPLGVPPVSAKLRAISRGEQGELPRQWVDSPPLGVGRKSSWGAVTSLS

SEQ ID NO: 778470 - protein, 330 aa, Homo sapiens
MLSLKLPRLFSIDQIPQVFHEQGILFGYRHPQSSATACILSLFQMTNETLNIWTHLLPFWFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSRFLEIQKPRLCKVIRVLAFAYPYTWDSLPIFYRLFLFPGESAQNEATSYHQKHMIMTLLASFLYSAHLPERLAPGRFDYIGHSHQLFHVCVILATHMQMEAILLDKTLRKEWLLATSKPFSFSQIAGAILLCIIFSLSNIIYFSAALYRIPKPELHKKET

SEQ ID NO: 778471 - protein, 330 aa, Homo sapiens; identical to SEQ ID NO: 778470

SEQ ID NO: 778472 - protein, 369 aa, Homo sapiens
MLSLKLPRLFSIDQIPQVFHEQGILFGYRHPQSSATACILSLFQMTNETLNIWTHLLPFCLFSMILVEGTKANQMEIDSRRTDLANEGELSSPWSCFGRFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSRFLEIQKPRLCKVIRVLAFAYPYTWDSLPIFYRLFLFPGESAQNEATSYHQKHMIMTLLASFLYSAHLPERLAPGRFDYIGHSHQLFHVCVILATHMQMEAILLDKTLRKEWLLATSKPFSFSQIAGAILLCIIFSLSNIIYFSAALYRIPKPELHKKET

SEQ ID NO: 778473 - protein, 115 aa, Homo sapiens
MSATQYTYNALECVNYEALLETRHSSIGRYLGMVRYNLVSYQSSESIVRSFDYRTLSPPFLATHQLRRNLIYVPAFSTLNSSKTLSIFSFVALLIKVQYFMVFSGITEMRMQNNF

SEQ ID NO: 778474 - protein, 134 aa, Homo sapiens
VAEHGTLMRAQERETTCCGNPVSSHISQAIIQMIVEDMHPYNYFSTPAFQRFMQIVAPDYRLPSETYFFTKAVPQLYDCVREKIFLTLENVQSQKIHLTVDIWTHDPSTDYFIVTVHWVSLETASFLNNGRIPD

SEQ ID NO: 778475 - protein, 71 aa, Homo sapiens
DPVNKSGGKAKKKKWSKGKVRDKLNNLVLFDKATYDKLCKEVPNYKLITPAVVSERLKIRGSLARAALQEL

SEQ ID NO: 778476 - protein, 68 aa, Homo sapiens
GYVRLKIRISKTWDEVRVESLMKMGQYYARKVAPAMALGEIKRGHKSCKNKDVGLTLEIPKSVTMKNV

SEQ ID NO: 778477 - protein, 83 aa, Homo sapiens
FLLVIKEPTKQNRRQRPMPLSVRQSVTWEFQMSGSYRTCWERCIEPRDQPRGTNGPRGRSFEPQLREELDAGRGSGLVDCTFI

SEQ ID NO: 778478 - protein, 160 aa, Homo sapiens
GTLEAMEGLVSHSKECGPGPQGGEGMAPHPEVSHRGVIRPVSAAVRRKDAVREEKVERRMAVQSTPGHASYHLPHYSSTENDCCYMTHWLTKEGAVCKQKQPTQGLQPSKDSAQPATPKAKKSQVHAHQSQHTWTQTMTVENEEQELGSRNNSASNVGIT

SEQ ID NO: 778479 - protein, 69 aa, Homo sapiens
GPRRGGRARGPRGGGAWMDPRVAWIQPEQKGPANALWMQIWETSQGVGRGGSGFASYFCLNSPALDTAA

SEQ ID NO: 778480 - protein, 170 aa, Homo sapiens
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIIANSA

SEQ ID NO: 778481 - protein, 110 aa, Homo sapiens [sequence omitted]

SEQ ID NO: 778482 - protein, 68 aa, Homo sapiens
VWGGPLLRSACAFPRPRPMHLPFRRSEHLFFHAQDDLVLSLAGTPCYLPSTGLVTEKAVPWNSSPAVG

SEQ ID NO: 778483 - protein, 121 aa, Homo sapiens
MGRGKESHRADPPDLGPSCTEAPGMQSRGRRVGSPRLLTAQTLPLQRWTWRAHLFTCVPASRTESQVATSWPEPVSRPACGQVDMGLPMVSACLSLIANNTRIAPAAILYTLFGKLSAHFF

SEQ ID NO: 778484 - protein, 179 aa, Homo sapiens
MAEEKGGKQVLEESAFEEMERDFQGVLHELSGDKSLEKFRIEYERLHAVMKKSYDNEKRLMAKCRELNAEIVVNSAKVATALKLSQDDQTTIASLKKEIEKAWKMVDSAYDKEQKAKETILALKEEIVNLTKLVEQGSGLSMDQHSNIRDLLRFKEEVTKERDQLLSEVVKLRESLAQT

SEQ ID NO: 778485 - protein, 722 aa, Homo sapiens
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDDRALLEDQLFIPDDCYYHGYVEAAPESLVVFSACFGGFRGVLKISGLTYEIEPIRHSATFEHLVYKINSNETQFPAMRCGLTEKEVARQQLEFEEAENSALEPKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 778486 - protein, 132 aa, Homo sapiens
PWTSPASCMFERCPLWRPPALVAAGPVVWHVQRPGLENGSWMSPSCFTFASHGRSDVSDTSDHTEHVAKACFVCSFPPVLRGYQEIRHDSRGPVHTARRSPAWPPGAPSRAGVSTGWSLWRSACRRVSQAVP

SEQ ID NO: 778487 - protein, 235 aa, Homo sapiens
GEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQR

SEQ ID NO: 778488 - protein, 172 aa, Homo sapiens
MTTTTADLTERCSVQVVVCITVLVHRMLVTTEASDSHLTDEDPELKATAELAQCLPLNHHITVGHFTNDALKSGHPAERMELNPFPTNCLRYAQCARGTADTQRQPSPRVHQDPSPAILHSFHLLMNMGRSTSFSSLLIDVTQTLLHSTVMLSRHALGTQQQLWNIPTCQGA

SEQ ID NO: 778489 - protein, 102 aa, Homo sapiens
FLTRASGARLLHFWGKRLQCTPRAPCWVADTGNLGLFVFCLCGSVCLEDPAIFSISNTHRLIMGPKILVWSARGPPVLTVGLGGRPGLILTTCVYCVSFPSR

SEQ ID NO: 778490 - protein, 120 aa, Homo sapiens
ITHGPDFNPASHLAPNATEPHDCISLIHIASSPFPHISILPIPNLDHTWFIDGSSSKPNQFSPAKAGYAVMSHTSIIEAAALPPSTTSQQAKLIALTRVLSLAKGMHINIYTDFKYAFHI

SEQ ID NO: 778491 - protein, 92 aa, Homo sapiens
AWENRMALDMILAKKGGVCVMIKTQCCTFIPNNTAPSGSITRALQGLTALSNELAKNSGVNDPFSGWLERWFGKWKGIIASILTSLAAVIGV

SEQ ID NO: 778492 - protein, 370 aa, Homo sapiens
RRARREPRRLRQPELPARRRLRRPPPSKPGRGASPAAMWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 778493 - protein, 392 aa, Homo sapiens
GALLIRACGFAEKRSSAQVLTRALVATSVPPCCSPTVARPTAPRGLGHKVKGRGASPAAMWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 778494 - protein, 146 aa, Homo sapiens
MTNNSGSKAELVVGGKYKLVRKIGSGSFGDVYLGITTTNGEDVAVKLESQKVKHPQLLYESKLYTILQGGVGIPHMHWYGQEKDNNVLVMDLLGPSLEDLFNFCSRRFTMKTVLMLADQMISRIEYVHTKNFLHRDIKPDNFLMGT

SEQ ID NO: 778495 - protein, 181 aa, Homo sapiens
RSREEENEHHGPSMPALIAPEDSPHCDLFPGASYLMTQIPGTQTESRAEELSPAALSPSLEPIRCSHQPISLLGSFLTEESPDKEIDQNSQQEESRLRKGTVSSQGTEVVFASASVTPPRTPDSAPPSPAEAYPITPASVSARPPVAFPRRETSCAARAPETASAPLSMDDPSPCGTSEMC

SEQ ID NO: 778496 - protein, 90 aa, Homo sapiens
MRTQPCDHISLPGRLGNVASPRTKEGGAATGEHTAQHPLVVPDHQVRPDTAGQPGSKDNETWSWFIGDEWNLFPEEPEKAKSLLCGKTGV

SEQ ID NO: 778497 - protein, 81 aa, Homo sapiens
DPRVAAEDEALSNIAREAHGWSESHYPQQTNTGTETQTLHVLTYKWELNNENTWTQEEEQHTLGPVEREHSGVRESIRINS

SEQ ID NO: 778498 - protein, 110 aa, Homo sapiens
SNFPDRAQAALKAAAAILRQFALSAIPIIGSVGTITSFSSPPLLCISHPVGLVGAPTSPTGRRQGGQICTAQEASLHSHGRSRWDEGVVCFLVSYQSKRVNAIYPRVQAG

SEQ ID NO: 778499 - protein, 111 aa, Homo sapiens
PGVPGQRPPRRRKVPPQALQRGRSRSPRGPASSISNRPGVPRVPPRPPEGAQKAQTPRPAPLPALSWRQSPGLRGRPSLYPCERVGDPGRLSGFPQPCSQLPGSAGFGLAD

SEQ ID NO: 778500 - protein, 342 aa, Homo sapiens
MNADFLLPYYTAQSGSSMSMFNTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTNVLNASIPKTSTELAEEPATGGIKEAAAAGAAAGAATGTVAGALSVAAANSAPGQVSAAIAGAATIGAGGNKGNMALAGTASMAPNSTKV

SEQ ID NO: 778501 - protein, 111 aa, Homo sapiens
LCCWMRTLVPSSKSPALASGQMPVPALSSLSMALGRLLWVVLIGLHPPGPEAHGESWPRQKWRMQCQHDTSGAWRLAPGLHLAASSPGLCPNPGECCPQKPGTFQPWSSLV

SEQ ID NO: 778502 - protein, 694 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 778503 - protein, 625 aa, Homo sapiens
METRGLADSGQGSFTGQGIARLSRLIFLLRRWAARHVHHQDQGPDSFPDRFRGAELKEVSSQESNAQANVGSQEPADRGRRKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 778504 - protein, 102 aa, Homo sapiens
RLETHSVVKMLSPKMLKKKRGKCERKISWVPSRWELLRANLPSILFKSSICSQRQMHILIASFGKTYQKLKRMQPSVSHLPVTSKPPIGGLALSCLRLSGRN

SEQ ID NO: 778505 - protein, 33 aa, Homo sapiens
HCHCLACHPAPHCALGGLNEGGEGCAGEEARGD

SEQ ID NO: 778506 - protein, 119 aa, Homo sapiens
QAQKAKLDGAWLEGDLSLADKDVTAKDSKFKMPKFKMPSFGVSAPGKSIKALVDVSAPKVEADLSLPSMQGDLKTTDLSIQPASTDLKVQADQVDVKLPEGHLPEGAGLKGHLPKVEMP

SEQ ID NO: 778507 - protein, 268 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 778508 - protein, 273 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEASRKKESSARLPSPNIRTMERKKMTRSF

SEQ ID NO: 778509 - protein, 268 aa, Homo sapiens; identical to SEQ ID NO: 778507

SEQ ID NO: 778510 - protein, 141 aa, Homo sapiens
MEMKKKINLELRNRSPEEDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 778511 - protein, 268 aa, Homo sapiens; identical to SEQ ID NO: 778507

SEQ ID NO: 778512 - protein, 268 aa, Homo sapiens; identical to SEQ ID NO: 778507

SEQ ID NO: 778513 - protein, 240 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQVNTHFLPALKINF

SEQ ID NO: 778514 - protein, 268 aa, Homo sapiens; identical to SEQ ID NO: 778507

SEQ ID NO: 778515 - protein, 253 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQKKEVFEGRRGNEMLKTMERKKMTRSF

SEQ ID NO: 778516 - protein, 268 aa, Homo sapiens; identical to SEQ ID NO: 778507

SEQ ID NO: 778517 - protein, 218 aa, Homo sapiens
MEMKKKINLELRNRSPEELELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 778518 - protein, 268 aa, Homo sapiens; identical to SEQ ID NO: 778507

SEQ ID NO: 778519 - protein, 164 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLQKDNIFLLLLKTEIPCSSS

SEQ ID NO: 778520 - protein, 150 aa, Homo sapiens [sequence omitted]

SEQ ID NO: 778521 - protein, 94 aa, Homo sapiens
NTSTSSGRVLVFPLPSPQIGGRARLHSGPGLCPGFPQSRAGRQGGRRRVSGQETSRKSGSRLFASPIEVRSAGRYGSQRELRRGGFGGGMKVRL

SEQ ID NO: 778522 - protein, 187 aa, Homo sapiens
PRLSPPISSDRWTCSPPLGARSMSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKYMTDGCLLKHILGDPNLT

SEQ ID NO: 778523 - protein, 104 aa, Homo sapiens
ANLTREALAEPHVCLVGGPVCCELESACLAKDPIWPRPKCSHKLGTLLQKWPSLRTVAVPPDSPRCHLRIKGRAGSWVRGLMRVIPEHWEAKVGGSLKPRSSIT

SEQ ID NO: 778524 - protein, 264 aa, Homo sapiens
ERKEGQGKEGGSGPAVVKKQEVKKVVNPLFEKRPKNFDIGQDIQPKRDLTSFVNGPHYIRLQRQRAILCKWLKVPPEINQFTQALDHQTAALLLQLAHKYRSETKQEKKQRLLALAKKKAAGKGGIPTKRPPVLRAGVNTITTLLENKKAQPVVIAHDVDPIELVVFLPALCHKMRVPYCIIKGEARLGRLVHRKTCTTVAFIQVNSEDKGALAKLVGAIRTDYNDRYNEIRRHWGGNVLGPKSVACIGKLEKAKAQELATKLG

SEQ ID NO: 778525 - protein, 108 aa, Homo sapiens
PGLESSASLAASSLRLRLLLERVAGLLLDPRGHCDRQGAFSTSTASPGTEGKALLYLSLTFCSGADPTLPGAANFVLVPGPSSPGMWAEHQPGHQEAKFQGLSLSLSV

SEQ ID NO: 778526 - protein, 108 aa, Homo sapiens; identical to SEQ ID NO: 778525

SEQ ID NO: 778527 - protein, 132 aa, Homo sapiens
MAHIERHHARSRANTTAQKNRDKQEETNKRRKIRRKRLKERTARKERRHTKDRRTKKREKTTKTERTQKTTTGKEKRTATQKQDKGEDTRRTGQINKAIEGQTDEEDDEHTKRHKRRTHNHTRHRERMRSNE

SEQ ID NO: 778528 - protein, 102 aa, Homo sapiens
VGKTASGSRKSEWDIPIFGLHPGCLYCGHLWEEMSSVKRSLKQEIVTQFHCSAAEGDIAKLTGILSHSPSLLNETSENGWTALMYAARNGHPEIVQFLLEKG

SEQ ID NO: 778529 - protein, 495 aa, Homo sapiens
VGKTASGSRKSEWDIPIFGLHPGCLYCGHLWEEMSSVKRSLKQEIVTQFHCSAAEGDIAKLTGILSHSPSLLNETSENGWTALMYAARNGHPEIVQFLLEKGCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGVVAQARSVLAWHSRYKFCPTCGNATKIEEGGYKRLCLKEDCPSLNGVHNTSYPRVDPVVIMQVIHPDGTKCLLGRQKRFPPGMFTCLAGFIEPGETIEDAVRREVEEESGVKVGHVQYVACQPWPMPSSLMIGCLALAVSTEIKVDKNEIEDARWFTREQVLDVLTKGKQQAFFVPPSRAIAHQLIKHWIRINPNL

SEQ ID NO: 778530 - protein, 301 aa, Homo sapiens
VGKTASGSRKSEWDIPIFGLHPGCLYCGHLWEEMSSVKRSLKQEIVTQFHCSAAEGDIAKLTGILSHSPSLLNETSENGWTALMYAARNGHPEIVQFLLEKGCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGKK

SEQ ID NO: 778531 - protein, 495 aa, Homo sapiens; identical to SEQ ID NO: 778529

SEQ ID NO: 778532 - protein, 477 aa, Homo sapiens
VGKTASGSRKSEWDIPIFGLHPGCLYCGHLWEEMSSVKRSLKQEIVTQFHCSAAEGDIAKLTGILSHSPSLLNETSENGWTALMCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGVVAQARSVLAWHSRYKFCPTCGNATKIEEGGYKRLCLKEDCPSLNGVHNTSYPRVDPVVIMQVIHPDGTKCLLGRQKRFPPGMFTCLAGFIEPGETIEDAVRREVEEESGVKVGHVQYVACQPWPMPSSLMIGCLALAVSTEIKVDKNEIEDARWFTREQVLDVLTKGKQQAFFVPPSRAIAHQLIKHWIRINPNL

SEQ ID NO: 778533 - protein, 130 aa, Homo sapiens
VGKTASGSRKSEWDIPIFGLHPGCLYCGHLWVSRSSGELVVSLPPLGAVTTSLGSLVPALPCVALLSCVAEPRSGLVGAGAGATDAFAGAPATGRRCGGTEVVEFPAQAEMGKRKRYLGCDFTSKEGISQ

SEQ ID NO: 778534 - protein, 64 aa, Homo sapiens
MCSKLHVSVGVGGETWSRWPGGRERDGTTVLLPLHWLLGPKALSLPRVFLPCNAPGLCKLSVPS

SEQ ID NO: 778535 - protein, 84 aa, Homo sapiens
MPRPLADLQLVVQDQHEARPHPHAFEGVGPHTLEKGLAPLISEDLPPTVDGARVHDVSSFAPGLHHRPPPHCVEGLGEHASHGR

SEQ ID NO: 778536 - protein, 141 aa, Homo sapiens
SGFTASSRPRVSPRVGSQPHPDPACHREWVHTLIPTPRVTASGFTRSSRPRVSPRVGSQPHPDPACHREWIHTLIPTPRVTASGFTRSSRPRVSPRVGSQPHPDPACHREWIHTLIPTPHVHVFNEHCARRSAVNMPQHPI

SEQ ID NO: 778537 - protein, 100 aa, Homo sapiens
VLEVAGVAMRTGPRSRQHYFGRSRINHDNRDSVFNSAAVDTGPWCWNPIQGQEQHGVTEHRLAFMSLYHFFFLPLTLPATCGDVEPFICRCLLRNRRKGS

SEQ ID NO: 778538 - protein, 75 aa, Homo sapiens
YWVTPVKDKGSGNQVWKGRSSHSSAGLSNTCESRGAEEEQLPVSSEEHQENVESWKPKEDSNSSRRVTSSVDQVK

SEQ ID NO: 778539 - protein, 519 aa, Homo sapiens
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRYGTMDSGTRPKNATRESTSTLKAWLNEHRKNPYPTKGEKIMLAIITKMTLTQVSTWFANARRRLKKENKVTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 778540 - protein, 261 aa, Homo sapiens
AAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEELRQIFQTGVKDKYDNDVKDSHPSLSAERGFFGPELASRWPGLCRRLQWLRLSGSVNAPTCLCLFPPFSVYRVVSDCK

SEQ ID NO: 778541 - protein, 127 aa, Homo sapiens
PPPRRADRGPRSWAAGQARLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQ

SEQ ID NO: 778542 - protein, 378 aa, Homo sapiens
AAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQ

SEQ ID NO: 778543 - protein, 103 aa, Homo sapiens
TLVAQAGVQWHNLGSLQPPPPGFMRFSCLSLLSSWDYRHVPPHAANFVLLVETGFLYVGQAGLEVGSSGDLPASASQSAGITGVSTAPGFNRYFYKQIIYKYG

SEQ ID NO: 778544 - protein, 674 aa, Homo sapiens
MQTSSSRSVHLSEWQKNYFAITSGICTGPKADAYRAQILRIQYAWANSEISQVCATKLFKKYAEKYSAIIDSDNVESGLNNYAENILTLAGSQQTDSDKWQSGLSINNVFKMSSVQKMMQAGKKFKDSLLEPALASVVIHKEATVFDLPKFSVCGSSQESDSLPNSAHDRDRTQDFPESNRLKLLQNAQPPMVTNTARTCPTFSAPVGESATAKFHVTPLFGNVKKENHSSAKENIGLNVFLSNQSCFPAACENPQRKSFYGSGTIDALSNPILNKACSKTEDNGPKEDSSLPTFKTAKEQLWVDQQKKYHQPQRASGSSYGGVKKSLGASRSRGILGKFVPPIPKQDGGEQNGGMQCKPYGAGPTEPAHPVDERLKNLEPKMIELIMNEIMDHGPPVNWEDIAGVEFAKATIKEIVVWPMLRPDIFTGLRGPPKGILLFGPPGTGKTLIGKCIASQSGATFFSISASSLTSKWVGEGEKMVRALFAVARCQQPAVIFIDEIDSLLSQRGDGEHESSRRIKTEFLVQLDGATTSSEDRILVVGATNRPQEIDEAARRRLVKRLYIPLPEASARKQIVINLMSKEQCCLSEEEIEQIVQQSDAFSGADMTQLCREASLGPIRSLQTADIATITPDQVRPIAYIDFENAFRTVRPSVSPKDLELYENWNKTFGCGK

SEQ ID NO: 778545 - protein, 674 aa, Homo sapiens; identical to SEQ ID NO: 778544

SEQ ID NO: 778546 - protein, 674 aa, Homo sapiens; identical to SEQ ID NO: 778544

SEQ ID NO: 778547 - protein, 674 aa, Homo sapiens; identical to SEQ ID NO: 778544

SEQ ID NO: 778548 - protein, 45 aa, Homo sapiens
LSHRGVAVSVDPSRALAQGLLSSLPILSTLSFRLSSFLVFSLPLS

SEQ ID NO: 778549 - protein, 99 aa, Homo sapiens
PYLIMLKGCTNLPLPENKELTSSMLELSHLVIVSQLMKIRVDKEMQWQILFQEEPAVWLQDSDRHTASSYRHVQGQPLLQTAISPRSQPSWSHLHMVTE

SEQ ID NO: 778550 - protein, 52 aa, Homo sapiens
MGLEMPLGSKGLESGASEICLVLYFTVAELVSSLPDQVLCNIPSPFLKQKSF

SEQ ID NO: 778551 - protein, 102 aa, Homo sapiens
AKEKPSVLPLSENLKALGLIRRGKKSYTEVAKIYGKNKSSIQVIVKEEKEIRASVGVATQTVKVTATVQDGCFVKTEKTLNGWVEDMNRKHVLITTSCTRKH

SEQ ID NO: 778552 - protein, 477 aa, Homo sapiens
TQPTARSLTSLLGTMSTCSRQFTSSSSMKGSCGIGGGIGGGSSHISSVLAGGSCRAPSTYRGGLSVSSSCFSSGGAYRLGGGYGGGFSSSSSFGSGFGGGYGGGLGAGFGGGLGGGFAGGDGLLVGSEKVTMQNLNDSLVSYLDKVRALEEANADLEVKIHDWYQWQRPAEIKDYSPYFKTIEDLRNKILTATVDNANVLLQIDNARLAADDFRTKRVCSGMRQSEPAHECGGRHQWHAPGAGVLDELTLARADLEMQIESLKEELAYLKKNHEEEMNALRGQVGGDVNVEMDDAPGVDLSHILNEMRDQYEKMAEKNHKDAEERFFTKTEKLNHEVATNSELVQSGKSEISELWHTMQNLEIELQSQLSMLGMVPGPVVHPELAGREWPHSLILDSLSLPSQKASLENSLEETKGRYCVQLAQIQEMIGSVEEQLAQLCCEMEQQNQEYKILLDVKMRLEQEIATYRCLLEGEDAQ

SEQ ID NO: 778553 - protein, 487 aa, Homo sapiens
TQPTARSLTSLLGTMSTCSRQFTSSSSMKGSCGIGGGIGGGSSHISSVLAGGSCRAPSTYRGGLSVSSSCFSSGGAYRLGGGYGGGFSSSSSFGSGFGGGYGGGLGAGFGGGLGGGFAGGDGLLVGSEKVTMQNLNDSLVSYLDKVRALEEANADLEVKIHDWYQWQRPAEIKDYSPYFKTIEDLRNKILTATVDNANVLLQIDNARLAADDFRTKRVCSGGPEHPVSPKYETELNLRMSVGADINGMRQVLEVLDELTLARADLEMQIESLKEELAYLKKNHEEEMNALRGQVGGDVNVEMDDAPGVDLSHILNEMRDQYEKMAEKNHKDAEERFFTKTEKLNHEVATNSELVQSGKSEISELWHTMQNLEIELQSQLSMLGMVPGPVVHPELAGREWPHSLILDSLSLPSQKASLENSLEETKGRYCVQLAQIQEMIGSVEEQLAQLCCEMEQQNQEYKILLDVKMRLEQEIATYRCLLEGEDAQ

SEQ ID NO: 778554 - protein, 120 aa, Homo sapiens
MALSRPHHVSNDPALFCLHSLSSSQFSSGSQSSRDRDLLQPPNPHQDHGCARWQGGVHPRAGPSHQELRLPSPAQAQEAPCVDTDPTRRSPLLPPKHFTPGPCFTLTPSWQSIQLHYLSC

SEQ ID NO: 778555 - protein, 445 aa, Homo sapiens
TQPTARSLTSLLGTMSTCSRQFTSSSSMKGSCGIGGGIGGGSSHISSVLAGGSCRAPSTYRGGLSVSSSCFSSGGAYRLGGGYGGGFSSSSSFGSGFGGGYGGGLGAGFGGGLGGGFAGGDGLLVGSEKVTMQNLNDSLVSYLDKVRALEEANADLEVKIHDWYQWQRPAEIKDYSPYFKTIEDLRNKILTATVDNANVLLQIDNARLAADDFRTKRVCSGMRQSEPAHECGGRHQWHAPGAGVLDELTLARADLEMQIESLKEELAYLKKNHEEEMNALRGQVGGDVNVEMDDAPGVDLSHILNEMRDQYEKMAEKNHKDAEERFFTKTEKLNHEVATNSELVQSGKSEISELWHTMQNLEIELQSQLSIKPSLENSLEETKGRYCVQLAQIQEMIGSVEEQLAQLCCEMEQQNQEYKILLDVKMRLEQEIATYRCLLEGEDAQ

SEQ ID NO: 778556 - protein, 72 aa, Homo sapiens
LNDSLVSYLDKVRALEEANADLEVKIHDWYQWQRPAEIKDYSPYFKTIEDLRNKVGEWAAEGAIPASSFWEQ

SEQ ID NO: 778557 - protein, 101 aa, Homo sapiens
AHRHACFESPKFFLLLLFFISFSQQTQMFFRHVESQEAQTWCPSTSSDKSPLSWPSITHRSNRDKNCHPSNHIRTSHALLEASELSQMPFPAPPPLCPPSP

SEQ ID NO: 778558 - protein, 68 aa, Homo sapiens
MSQHPLGLAHSIFCLSGGLCFFSLAHDSSNSGPWQQCHGKHGHRCRPQNRMAGLSDEAVAQICRNWQV

SEQ ID NO: 778559 - protein, 165 aa, Homo sapiens
MTKTDRMPRWAERLFPANVAHSVYIILEDSVVDPQNQTMTTFTWNINHARPMVVEERCVYCVNSDNSGWTEIRREAWVSSSLCGVSRAVWEFGLAQFKSNVTKTLKGFEYILAKLQGEAASKTLIKTAREAKEKAKETALAATEKAKDLASKAATKKQQQQQQFV

SEQ ID NO: 778560 - protein, 76 aa, Homo sapiens
STIVVWGAELVVRQIVVVACCGGGYRRRRSLRWVWTDCPGKDAPHPSSSLLHGGLDTGVGGASCLLACLPLDWGQS

SEQ ID NO: 778561 - protein, 155 aa, Homo sapiens
PDLVIHPPCDSQSAGITDVSHLCPAKPGDTFSGQFVLGEPQGYGVMEYKAGGCYEGEVSHGMREGHGFLVDRDGQVYQGSFHDNKRHGPGQMLFHACGARWEEPVRVTATTRLPLLRVDSVRVSPRNGDKYDGDWVRDRRQGHGVLRCADGSTYK

SEQ ID NO: 778562 - protein, 558 aa, Homo sapiens
GPSSEASSLPAESWAPEGLPTTAPGCAIATSSQPPAQTRDSPSMAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSTPSRVPSRAPSPAPPPLPSSRRSSMGSTAVATDVKKLMSSEQYPPQELFPRGTNPFATVKLRPTITNDRSAPLIR

SEQ ID NO: 778563 - protein, 105 aa, Homo sapiens [sequence omitted]

SEQ ID NO: 778564 - protein, 572 aa, Homo sapiens
GPSSEASSLPAESWAPEGLPTTAPGCAIATSSQPPAQTRDSPSMAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSIAPSEYWDGQSRSRTPSRVPSRAPSPAPPPLPSSRRSSMGSTAVATDVKKLMSSEQYPPQELFPRGTNPFATVKLRPTITNDRSAPLIR

SEQ ID NO: 778565 - protein, 548 aa, Homo sapiens
GPSSEASSLPAESWAPEGLPTTAPGCAIATSSQPPAQTRDSPSMAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSIAPSEYWDGQSRSRTPSRVPSRAPSPAPPPLPSSRRSSMGSTAVATDVKGHKSFCHCQASSHHHQ

SEQ ID NO: 778566 - protein, 83 aa, Homo sapiens
QMVPIGRLTQDTGSGRQPVRAGSQPLQKPGIAGQELFQRPPLTPNQRVLTKGFQERGLGPAKHLGAAVEKGETIIRHDAKNEL

SEQ ID NO: 778567 - protein, 114 aa, Homo sapiens [sequence omitted]

SEQ ID NO: 778568 - protein, 86 aa, Homo sapiens
PLGHGVCLRGRGPDRGHDGHPRARCCPAAPADDALAEEGEAWARGRATLILSPWGDHTSRSLAADPSHPCLCGPAHLGNTPRNKVP

SEQ ID NO: 778569 - protein, 165 aa, Homo sapiens
NSRWIKDFNVRPKTIKTIKENLFKTIQDIGMGKDFVTITPKAMATKAKIDKWDLITLKSFCRAKETVIRVNRQPTECEKIFAIYPSGKRLISRIYKELKQIYKKKTTPSKSGQTSQMKTFTQPLYADTSTVQISVNILVSRDSNRKIVSASLLPTHFKHIQLVEM

SEQ ID NO: 778570 - protein, 188 aa, Homo sapiens
PVPALSAYWIPGAWAGAWALLPPWPLRPLEAEREPLADPRLVPSTADTRKVARASLSRTDGRPPTQAGAMDKFRMLFQHFQSSSESVMNGICLLLAAVTVKLYSSFDFNCPCLVHYNALYGLGLLLTPPLALFLCGLLANRQSVVMVEEWRRPAGHRRKDPGIIRYMCSSVLQRALAAPLVWILLALL

SEQ ID NO: 778571 - protein, 112 aa, Homo sapiens
RIKLDSYISPYIKINSRLIKYSNVKTYKIPRRKPRKTLLNISLDKEFMTKSSEANETKIIIGKWDLSKLKIFCTAKEIINRVNRQPTEQEKIFTNYVSNEVLISRIYMEPNK

SEQ ID NO: 778572 - protein, 87 aa, Homo sapiens
MLGALPEVVGFDSVLNDSLHHSHRHSPPAGPHYPYYLPTQQTAPDDASAAASPALPAPPAGAPDQRPHALQAGHTPRRPLGLPAGAM

SEQ ID NO: 778573 - protein, 106 aa, Homo sapiens
CAGQVSGRPHREPLAAFGLLHRKSSSCMVLGIPVSWLGLGADRNGTVLWLITYGSRPCACGGVSAPSLWFWQWRGCGAASCVPPHRIYECAPGAPAADKIGTITLG

SEQ ID NO: 778574 - protein, 124 aa, Homo sapiens
EALRQGEVSGKSYGNVQEQRLAFLGNVQGFRQILIGTGAIPFSAVISIVRFFLSGSNFHSTIRYSLLSTNLICHTLCHHTLLLIFRISCLQIPGIFQALLSQRMCVMTPLLYKTHTHIYFKNPP

SEQ ID NO: 778575 - protein, 71 aa, Homo sapiens
TSGQLLAAAGSKEQRRQGRMGGPDKPDGVELSQADALGLFCLPRDHLESQRLWARGQQAGSLAGPVDSRPG

SEQ ID NO: 778576 - protein, 117 aa, Homo sapiens
MGPQCCTPISGPAPPPLTPALILKGGNIHPKLPQFTSVTWWPVSGVSNGSSVAVCITIASRGCSAHLCPPPDCQDSLLPPCHFTQSAAVAAAVTPQTRTPASRASPGLALLCLSGLP

SEQ ID NO: 778577 - protein, 78 aa, Homo sapiens
AAARAGPCGAQVRSREGLDNPDREPDPCSDRRKQYLEEKLERESIPRIAERWTTDRIDGVSPIPDTIGSTSMNSTNCK

SEQ ID NO: 778578 - protein, 53 aa, Homo sapiens
MACLENEGLNQISVGLRDVGAGTGCEDSSFPSLVTSSAGCGSTQLSSGHLFLD

SEQ ID NO: 778579 - protein, 69 aa, Homo sapiens
HTPASPPESWDQSGCRGSQSGPPSASLPCLQMSSHGCVRPRPDSPSLWSYWVQGPPSTPESKAWPGLSD

SEQ ID NO: 778580 - protein, 72 aa, Homo sapiens
MSLLAAPVEQVFGGTGQELPGGVPHMTPTRQNAGLGLLGWGCWAAGRTHAPTAAATTLPPGQAPTPPGPRLK

SEQ ID NO: 778581 - protein, 78 aa, Homo sapiens
LPPELDVGGGGAWGLGLGRWALLWPARVGPGEAALQELCGQLERYLGAAAHGCGCATVRDALFAANGRAADCESPREF

SEQ ID NO: 778582 - protein, 36 aa, Homo sapiens
ACAAAPYGYEPCLVSVSCVTDLFNLVLLPAFIATQL

SEQ ID NO: 778583 - protein, 95 aa, Homo sapiens
RGWAVGHPQLLVSVIRACRTPCPEPQPRWVHLGSMERDSHSLQRASDGGRGRFHVPGARMQQEKRGKMRPRPTSARSTSEEEFPPEDPTTRMSQS

SEQ ID NO: 778584 - protein, 183 aa, Homo sapiens
MCHNLIMWLRKLLWNNRWSSPIFQRTVKTSRKIQGTWKEFIHKPGKERNWIWKANEEHHRLLKGAPFKLNLHPRDYFDANPYFSEESLPPIKKEEKKKTISNTFKPSSPGKKPGGMKAGTFDPYPSHSADPYVAKLANISGKDDKIFHPPSGPKSRPVESIMTLNVRRALNSKNYKTSSVPSY

SEQ ID NO: 778585 - protein, 183 aa, Homo sapiens; identical to SEQ ID NO: 778584

SEQ ID NO: 778586 - protein, 150 aa, Homo sapiens
GPELAGRTEPPGLMAQKPLSTAAAERMNLVGQDEIWKYRLKAESEARQNWPQNWGFLTTPFEELIKCEEDLPTPKPKIELPERFRIRPVTPVEKYIKVFPSPPVPQTTQGFIGWRSAVPGLNKCLELDDAIRSCKGAFARELCWPKQGVH

SEQ ID NO: 778587 - protein, 46 aa, Homo sapiens
GGQKFPWSWAEAQAGEQCQGDCREWAFCRRVEGDRRVCQLSARMTV

SEQ ID NO: 778588 - protein, 135 aa, Homo sapiens
RESISERDPGPTRQVSAQQPEHCGRVSAFEPRPVREGTQESSVSPACPPTKFTKHSLSHQVVTTPCVQEAIYFERPLWAVDEAFAKSFLLVKQMGLLGCYTLGTRVLATKETLSLPSPCLTKLWVQTSQQAGAGL

SEQ ID NO: 778589 - protein, 259 aa, Homo sapiens
MSHWAPEWKRAEANPRDLGASWDVRGSRGSGWSGPFGHQGPRAAGSREPPLCFKIKNNMVGVVIGYSGSKIKDLQHSTNTKIQIINGESEAKVRIFGNREMKAKAKAAIETLIRKQESYNSESSVDNAASQTPIGRNLGRNDIVGEAEPLSNWDRIRAAVVECEKRKWADLPPVKKNFYIESKATSCMSEMQVINWRKENFNITCDDLKSGEKRLISKPTCRFKDAFQQYPDLLKANKGRDCKANANSVTGMANYSTRN

SEQ ID NO: 778590 - protein, 106 aa, Homo sapiens
GDGWWEDRQVPESLSCPCSWGAEMLPRDGWGNGKETVWIPRSQLAFQLCLSAPCTRSVTPTHTVSVGHEKRPVSAAASEPRVGFNKWKEPRGEMAKACEMQTSGEE

SEQ ID NO: 778591 - protein, 32 aa, Homo sapiens
MKQKNLTSSGFLPLVWYSSHKSNLETAKSDWQ

SEQ ID NO: 778592 - protein, 530 aa, Homo sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 778593 - protein, 530 aa, Homo sapiens; identical to SEQ ID NO: 778592

SEQ ID NO: 778594 - protein, 555 aa, Homo sapiens
MLLWPLLLLLLLLPTLALLRQQRSQDARLSWLAGLQHRVAWGALVWAATWQRRRLEQSTLHVHQSQQQALRWCLQGAQRPHCSLRRSTGSHQSCLKLLGNWLPEAFLFVIGAIDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 778595 - protein, 611 aa, Homo sapiens
TREWARDIVTQLLCARPTLSETLPIRKQSSVQPTKLLRALQLTSGRGRICTQELLGDAAVATAAAAAAAANIGPAQAAAVPGCQAVLACWPPAPSGMGGPGLGSHLAAAEAGAEHAPCAPEPAAGPEVVSTGSPAPPLFPQKEHRVSPVLPETLGKLASCGVSVVIGAIDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 778596 - protein, 120 aa, Homo sapiens
KGHPCVLGSTASPFLLFRLDQTLSVRGEDIGEDLFSEALGRAVGQWAGAKLLDHGCVESSILGEPPHRLLPTILELPFNSYLPCQGTARKEISLLYYSYKSPSLHLTLIHPAAVSTHFLS

SEQ ID NO: 778597 - protein, 487 aa, Homo sapiens [sequence omitted]

SEQ ID NO: 778598 - protein, 530 aa, Homo sapiens; identical to SEQ ID NO: 778592

SEQ ID NO: 778599 - protein, 474 aa, Homo sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILEWGRTDRAEDTRLGSCPFTGSMCAHGVYSQIPLRALLPTTRCLWR

SEQ ID NO: 778600 - protein, 499 aa, Homo sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 778601 - protein, 164 aa, Homo sapiens
KGHPCVLGSTASPFLLFRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLGGVLSQVLPHRPAPPRGHLAPPSGTSPDGESLARVSDSVSPDICP

SEQ ID NO: 778602 - protein, 101 aa, Homo sapiens
MESQLPAAVTHSFMYFLRGLSLPSLPHSPALGFLGWLPNKPLAPRFLPQGLLWGNGSGPRPSHSPTELQDFPPTFCSGPGKAACAHRSLGGLVAHPRPAPT

SEQ ID NO: 778603 - protein, 43 aa, Homo sapiens
SSSVPGSVNFTATLAHSVPACAVADMPSPRNTSHTHTREGRMQ

SEQ ID NO: 778604 - protein, 114 aa, Homo sapiens
MRVSSISMITFICSWKLCLPPYATAIQRLASLSLKVWRVSDLQDSQEGKPTEIPTDKVFCPLVPTRKPRLGLGQQPNSSLEADLMVDVFSHLSKIGEDYFALNKLTAKKKFKKT

SEQ ID NO: 778605 - protein, 121 aa, Homo sapiens
MCCVHTFVCECICVCLCVDSWCVCLRVEVSGRAWGTLRNLVPAAPSSPSFSLGTEEALFSPAHLLSASSQLSCCSALKQTFFPRCICLYLFTPCVHLKAPGLVGWCSHAAHRRDTGFHSLL

SEQ ID NO: 778606 - protein, 180 aa, Homo sapiens
GSRARAASRERAGSVAAPCGRSRRPGLTTRRKTRGLWQLQRDRVGWAPGPPGLQRERPAVQAAGRARPEAEARRDTRLRPKRPGWVGLAAAASPVLKRQPGRCILPGVCKTPAQGIPPIPALKASLLGALLGKPTRLGGPLMGMWSRPSSTPEAEGPPGFRRKPTSTLDASWRMIALSGD

SEQ ID NO: 778607 - protein, 105 aa, Homo sapiens
MWFPFIFKEPAFLVEQHYFLLFVLNSLILLLVCSFSSVRGSVSTTPILLSHPQSSSTEVSQLCEAASYQNLHKDLHHLCLVPALGLLWCPMWDTCGHLLGPEVQR

SEQ ID NO: 778608 - protein, 121 aa, Homo sapiens
MQRNSAFQEHGTRRAPTSSLVHNGPLKLNIQRIQTAAELLKVFSLNCLCFKAKKKEEDKTRREKNTVWCGARPAPLKKSGPRRRKAFRKNQLRVGARAAGPRGEVYGCNRGPKGAVFQRGN

SEQ ID NO: 778609 - protein, 197 aa, Homo sapiens
CPIAELSEGHLRKAEPTRTLGGISASENARWQPKSVALALWRSVFQGGDERGRRIRGSKDAGRSEVTCNHGTKNLVVYNKCSLLSHARGHKEKGVVSAMLPLNFKASPSRSNDSCSVRQYFHFNFHSSEPVWELSQTLSTKIQSGITGTVISAPSSTRITPAMPLDEDPSKLCRRSLKCWECNEVFQDETSRGTHFQ

SEQ ID NO: 778610 - protein, 82 aa, Homo sapiens
STATSPPPLAPPVALDKRVGFSLSMGFFGGDVTSFEPFPLNMLLLHGRDRGRGETLSPPPSSGPSTARPLASLASVPSDAGR

SEQ ID NO: 778611 - protein, 112 aa, Homo sapiens
AASGERAVLGGRPGEPPGSPSPFPGPRGDTPSPPPGPPRGPNCGSGGPGQPKGKWGYPTARQRGWGQTREPEVGDVRQSPAGRFQRGDPGLQGTPLRGSYPASAHCQCYVAA

SEQ ID NO: 778612 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 778613 - protein, 254 aa, Homo sapiens; identical to SEQ ID NO: 778612

SEQ ID NO: 778614 - protein, 282 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGELTGVCLPSSRRSSAQSRGLTQSSAVPGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 778615 - protein, 159 aa, Homo sapiens
MVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 778616 - protein, 159 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 778617 - protein, 237 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKPLLPQTQRSNAT

SEQ ID NO: 778618 - protein, 127 aa, Homo sapiens
MKLTPKYILRKEFRNICSQPLLPQAQESRPPAPPPSNQGYRSPAPPPSDPGVQTPQPLLPQTQESSPSSLRPRSPDPPAPPPSDPGVQAPNPSSLRLRGPSPQPLLPQTQRSRSQPLLPQTQRSNAT

SEQ ID NO: 778619 - protein, 80 aa, Homo sapiens
RGEENGLLNYRGGPQGLCPQRMMYKVGLEQLSLSSNHGAQDSEQTAGIPTTGQGLYTAILLQPTRLLTASRIQTGKRRGQ

SEQ ID NO: 778620 - protein, 783 aa, Homo sapiens
DVPGTLMEPGRGAGPAGMAEPRAKAARPGPQRFLRRSVVESDQEEPPGLEAAEAPGPQPPQPLQRRVLLSEDAPPLAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLA

SEQ ID NO: 778621 - protein, 105 aa, Homo sapiens
MQPGHAALNDASHACICPAPRPGSVSYLRGRGCSPAVPIGWEVLAAAPSPGWQQGAVQLCLGCSCWGGWRCFAPLPLQPAHLLTLVSPPPPGQGVWQGTWGPFVS

SEQ ID NO: 778622 - protein, 110 aa, Homo sapiens
GAAIGESCILGPATSLLLVKMQKLRPGTTHLTPSGLGFRPLTIFFQLQEQQHLEDPNLLSSSTRPQQSPTWKGTEPAWGFPGTFLTEHWKDPFIPSCPPGGTPRPEVEQR

SEQ ID NO: 778623 - protein, 68 aa, Homo sapiens
VHVACCCGNILCHCFNKYRKNEAKRREVIMNGLNSLFLVVSINDTILGGENLRVLPMLMQTPFDPAIP

SEQ ID NO: 778624 - protein, 153 aa, Homo sapiens
PRRQRPQEVEALAGGRAGAVGVGRRGGRGLRGGGRGVGGSSLLESPTSAPGRRGGLSETPLRTLLSRYRRNCDPAANTASPMHRLDCGTALPKPTDTSDAKAPDSQRKEPTVHTQRKKGSEALAKSGRGQPAANNPTHTTHPAPKHQRDRPNQ

SEQ ID NO: 778625 - protein, 80 aa, Homo sapiens
FMGQVSTKQTRMLCEPQSSAHKVPGLECPAVTLTSDEPAWKRTDLWRRGSGPQEQAWRGAEGKVAMAGFMEGRRPGAWFG

SEQ ID NO: 778626 - protein, 36 aa, Homo sapiens
MTREEMAESVWGAQAARLFCTKTKGENSAHETLGRL

SEQ ID NO: 778627 - protein, 101 aa, Homo sapiens
RTVTATVPGDGSLRLGEVGALCDCAVRVGAETSPGQAVTRTVSGGRDSRRVRQEEETSDRSPGTQHGIPASGVHGRCAESSISGRPQYCQAGRNPSHEDRP

SEQ ID NO: 778628 - protein, 127 aa, Homo sapiens
SPTMSSFQRVYVSHTPETPIKSETSVRSSPVSLTSSPPALMNPPVCASYSPTMPTFQPQSVPGSQGSPPSSPLSLCYSPDSTTCLYPNLWKSPVCPSYFPTSPTFQQESVAGTEKSPPNSPISLRYS

SEQ ID NO: 778629 - protein, 166 aa, Homo sapiens [sequence omitted]

SEQ ID NO: 778630 - protein, 105 aa, Homo sapiens
MGTEKGDHVPTHLLPSPDFTSGSATRQGAVWQLWGSAPHLSLSKMPFRLSVRSPMAVAMYIRVTWDAVKSPDTHIPAPLPLRARAGGLGTGLMASTLHSPSNFET

SEQ ID NO: 778631 - protein, 105 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICK

SEQ ID NO: 778632 - protein, 37 aa, Homo sapiens
MDTGEARTLARLETLARARDTGEARDTGEARTLARLE

SEQ ID NO: 778633 - protein, 132 aa, Homo sapiens
MNTSGCSAMKWKSIDSPLGTDLCASKTHALSAGNLYSSSSSPCQHQHSTFPFLLRFESQSQLQLVPLPSETPPGNTSSQITPARTSNDYEYSTWVCRLARTKRTDYYTRSGYGGEICPLQTMTVVAGKGLVK

SEQ ID NO: 778634 - protein, 49 aa, Homo sapiens
MCYNKTMVLIYDERGDVPPRFLFKEGLVSSADGIPVNRDLSGASDLEKA

SEQ ID NO: 778635 - protein, 41 aa, Homo sapiens
MEDRDLINSPAIRGAHAGAPHWPNPSGRQKARKPANLSQVI

SEQ ID NO: 778636 - protein, 116 aa, Homo sapiens
MKKTSGFRRGKGELPWGSVSSPGKVGAGAGSESEDHASSQPRRHDPDKGFDRLRRAAGRHRTETMRRILSLPKSGVDDRDEKNRLSCGQSSGDSWLSVDDEPFDSDTKILLSNIIT

SEQ ID NO: 778637 - protein, 42 aa, Homo sapiens
TAPLNQLMRCLRKYQSRTPSPLLHSVPSEIVFDFEPGPVFRG

SEQ ID NO: 778638 - protein, 117 aa, Homo sapiens
CSSPSGETASHLLSSHSLCFDIYFFAMFSYLALTHLSQSSPRASSSTNSPLANPVPSQRQWNWHCSPWFTYIFHAHTCHIYCDTLLHSLLPCLSPPSRLKASVTTGTTWYEMITHAC

SEQ ID NO: 778639 - protein, 122 aa, Homo sapiens [sequence omitted]

SEQ ID NO: 778640 - protein, 419 aa, Homo sapiens
MWPGNAWRAALFWVPRGRRAQSALAQLRGILEGELEGICGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 778641 - protein, 113 aa, Homo sapiens
PRQAGALGRGRSDVAWERLARRTLLGAPRPPRTVSAGPAAWHSGGGVGDARLASRMADDMLKRGIFVIGFSYPVVPKGKARIRVQISAVHSEEDIDRCVEAFVEVGRLHGALP

SEQ ID NO: 778642 - protein, 445 aa, Homo sapiens
MWPGNAWRAALFWVPRGRRAQSALAQLRGILEGELEGICGAGTWKSERVITSRQGPHIRVDGVSGGPGTVIFPGLPLPHLSCCIHLLSFTSGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 778643 - protein, 239 aa, Homo sapiens
MADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 778644 - protein, 419 aa, Homo sapiens
MWPGNAWRAALFWVPRGRRAQSALAQLRGILEGELEGICGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHWAGT

SEQ ID NO: 778645 - protein, 250 aa, Homo sapiens
MWPGNAWRAALFWVPRGRRAQSALAQLRGILEGELEGICGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRVGPCGT

SEQ ID NO: 778646 - protein, 481 aa, Homo sapiens
MWPGNAWRAALFWVPRGRRAQSALAQLRGILEGELEGICGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFESRALVQPGTETRGPQREAQNTLPLYPEERPGWQYSFLICWSPGQGRSPGWLNDGSTLTASLQALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 778647 - protein, 167 aa, Homo sapiens [sequence omitted]

SEQ ID NO: 778648 - protein, 80 aa, Homo sapiens
RMITPLHSSLGVRARLWFVCLFICLLKLFCRAEGTIPESDAREDKEDKISTTFSKALRRMQHPSRHHEAPRIWSSCFFRE

SEQ ID NO: 778649 - protein, 235 aa, Homo sapiens
SRAPVPAAEIGQPRRRWHSSGQRRLRELEPQQPPASPGPADSPRNQPKDAGRGRRRRHGVLPPSRPSPATWSSPRPRPSQTHQNETRRLLAASHTARSLPAGCAGMDGPRNQQRPGCGCGGVTGRGAQSFEDHKKRRGFQSSKELLGSYGKKFCSRGSRCVLSRKTGRARIAVPWEDAGTSYVLCAGYDGRYHDNAHVSSTVLLALLGTRITDHPEEGPGPSSDTATGAVRPLRM

SEQ ID NO: 778650 - protein, 86 aa, Homo sapiens
EKQRSPKSISLRGQWTQLCDCPVLCGSVEGPVMGHRATHSQLHPSPSLALFPYTETGWGLLIWPEALLWALKTGAISLPEDLEAAC

SEQ ID NO: 778651 - protein, 120 aa, Homo sapiens
LLRGGTIPHPLSPFSTCSSLAFALTRSTVTTPLCPHLAWLPSSTECSRVSIFFWLKDTPFCGLLQVTFQGFRPCFAGYPPSANPAVGLLLSEQISRGWGKRVSCLPIWFGSMSLLKSHVK

SEQ ID NO: 778652 - protein, 83 aa, Homo sapiens
TQVWSSDKKNEQGYSQGSTGIWRLLGPREAVEALKETGWSSRHIQDRALRTPKDPTAGSLSRSEDAGGKSTWEGAGMGLAQVG

SEQ ID NO: 778653 - protein, 72 aa, Homo sapiens
MFCYFCQFFILLFQAGNFIVLLFNFFMKFLIFLKFERPPGQVANIDVLNGIAKEVEAQAPDLGKHKGRKKNE

SEQ ID NO: 778654 - protein, 191 aa, Homo sapiens
SGWGWAPAHLWSSLRRKDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSERKCMAEICYAECLLQKAALTFVAG

SEQ ID NO: 778655 - protein, 203 aa, Homo sapiens
MALVCWVGSFGFASKALRDSVCRFYIGLCSLTWRSVGGAYGSSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSERKCMAEICYAECLLQKAALTFVAG

SEQ ID NO: 778656 - protein, 263 aa, Homo sapiens
QTFLLSPNSMLKRFFLLKVTYLFPQECQDGGYGGLVHWFSNCYVPRSILGISSNADSGVLGPGLRLCIYSKPPGDADTDLPWSSKGLVESASSPDLSAPRPALTLVPSEPLSSLLSTGVRVTTCSCRGDKMRETIFKTCNNASSQKIEAVQRYCSLSCFLGNSTSTWSGGGSRAGGRGHDITTPVHSVSWLLSTLWKYFSQGCWRNIRSFRNLGAFEIYAKTFKLDSFHFLGVIFIFNVTYHKRKERDENNFSCRDFLTEDGS

SEQ ID NO: 778657 - protein, 273 aa, Homo sapiens
METVFEEMDEESTGGVSSSKEEIVLGQRLHLSFPFSIIFSTVLYCGEVAFGLYMFEIYRKANDTFWMSFTISFIIVGAILDQIILMFFNKDLRRNKAALLFWHILLLGPIVRCLHTIRNYHKWLKNLKQEKEETQVSITKRNTMLEREIAFSIRDNFMQQKAFKYMSVIQAFLGSVPQLILQMYISLTIREWPLNRALLMTFSLLSVTYGAIRCNILAIQISNDDTTIKLPPIEFFCVVMWRFLEVISRVVTLAFFIASLKLKSLPVLLIIYF

SEQ ID NO: 778658 - protein, 112 aa, Homo sapiens
MVLRPYFENHLLRLCLTGWVPHHQLCPSGPHGPPFVDEGTSSGLRNLVRVTPGARIPAGPRTQVSQPQARPLTLSLRVWDPPRPTLLCPDPGTAAVCSPARDQWPGVHSPHD

SEQ ID NO: 778659 - protein, 101 aa, Homo sapiens
DLSSLQPLPPEFKRFSCLSHLSSWDYRCTPPHRRTFVFLVETVFHHVGWAGLELLTSGDPPTLAYQNAGIAGVSHRAQPQTTVFVECFLLETEHLWPVAGE

SEQ ID NO: 778660 - protein, 122 aa, Homo sapiens
ESMCKLSMISPFWDESHTTQFSLQQNAATRVSCFCPGKPTRDSVPRVYTGGGSHRHPVLGSCQIPQSQLTGKQMFTINHIVNLRKAKHLCQYMELLRSLIPKCQPRVNLISRFFFILFHFYK

SEQ ID NO: 778661 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVALVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 778662 - protein, 348 aa, Homo sapiens; identical to SEQ ID NO: 778661

SEQ ID NO: 778663 - protein, 201 aa, Homo sapiens
MCLLSSSAASDLAATSLTAHPCHPPLPRQPQPQLILSGSPSIGTVPPPAVGHTSLLPVNPPAISTTTSDLSAREDATPSASTGHLSVFPAFQVKIPAVPSEQTSQSFSEASHRVLPGGGPRCSRDFGAGVAGHLGLGIFGVGFGSPALLQSVVDENSCCLLYVVEDQLCDVEQAFRAEHLGQHQSGSGTGCRHCPQRPAAL

SEQ ID NO: 778664 - protein, 201 aa, Homo sapiens; identical to SEQ ID NO: 778663

SEQ ID NO: 778665 - protein, 201 aa, Homo sapiens; identical to SEQ ID NO: 778663

SEQ ID NO: 778666 - protein, 201 aa, Homo sapiens; identical to SEQ ID NO: 778663

SEQ ID NO: 778667 - protein, 201 aa, Homo sapiens; identical to SEQ ID NO: 778663

SEQ ID NO: 778668 - protein, 201 aa, Homo sapiens; identical to SEQ ID NO: 778663

SEQ ID NO: 778669 - protein, 201 aa, Homo sapiens; identical to SEQ ID NO: 778663

SEQ ID NO: 778670 - protein, 107 aa, Homo sapiens
MQTLSSTTSGTLIRFSSSCTSKFVSATPWGGSTGSPPSLPVPGGLSGFPKESRWDFLQRCCARRGCRMHVAGGSHSGHCVFSGTCLLPRYGRLKRCRCCCDQHEVSL

SEQ ID NO: 778671 - protein, 66 aa, Homo sapiens
PRLARQAFYVLSHLILTVTDEVGILLHLTDRFPKAIKELVRLSDRTRPSPRFSDAQPHPLTAISHG

SEQ ID NO: 778672 - protein, 115 aa, Homo sapiens
TGKMAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVK

SEQ ID NO: 778673 - protein, 121 aa, Homo sapiens
MASGTCYGAAVAQSTRSCWRGAWPLTHEVGHRLGTEGGLCSCPRTRMCDEGSGVAGYWGKVGLLFWCQESQVPTWEKRKVDSHGIQIPPGGCPEGSTFDPEPHPDDLTDKAPKSLCCSGSG

SEQ ID NO: 778674 - protein, 72 aa, Homo sapiens
PSSLGSESCARELLPHSSGSHTPEFVPPLLNILWTPPFLPSWVEESFLLVHFHFILKNSKERGLLFVGMNHL

SEQ ID NO: 778675 - protein, 173 aa, Homo sapiens
MSPSAFSLLSSHPTPSQPPPSSEPPSPSQYTALKCVPRRRTFTTRCTLNSLGPAVREQGIEMLTCSSQVSGSLELAWELLRSSRYSRKLPIHASACGSEAGSSQKIAPSCCKAHHCHLPATASLFHSPNPLYWQALIWNYTGDGILENPSDFSRMQGDHGRGTSLQGTAGANC

SEQ ID NO: 778676 - protein, 61 aa, Homo sapiens
PRGSDEGISCMIEGPCGSDEGRSSCMVEGPRGSDEGRPLHMVEGLCSSDNGRSSCMVEGPG

SEQ ID NO: 778677 - protein, 199 aa, Homo sapiens
KGHPTWVLLHLPTHKDFNLCCQWLFSGLWAPPQLCPCCTVYPLAFLACGSEQSRSPIPISRAPPPPPPPSWSLYRARREVGTWQVIQDRHLKSRSQNLRLGQVVPKPSSSAPLRGAKNQTGPSPQPRRSRLLLPTDRHMSSFAEDSFPSQTPALGACQGPLPSWLDLDTPGMLRLLYLLQLPHLTGGSLYATSESRCIS

SEQ ID NO: 778678 - protein, 224 aa, Homo sapiens
AFLRLSRRAAGLLLLPPRAPAAMFNRAVSRLSRKRPPSDIHDSDGSSSSSHQSLKSTAKWAASLENLLEDPEGVKRFREFLKKEFSEENVLFGLACEDFKKMQDKTQMQEKAQGDLHDLSVQQGLITGQRGGAVSAQREDPGRTDPLMFQKLQDQIFNLMKYDSYSRFLKSDLCLKHKRTEEEEDRLCLMLKLQLKELPEFITHEPPKSRDWAALRSKGMSSQD

SEQ ID NO: 778679 - protein, 109 aa, Homo sapiens
MSPCEVISRSEWVMFADTPRLSMPFLCLLSTAVEYLSWTLVMVCLVCSLPSNSSAIPQLQLSFPNMDLIKALSSLTASLSPGLPALLAILLAAPPLGTITAPFTLPCRL

SEQ ID NO: 778680 - protein, 148 aa, Homo sapiens
EAPAPPKAEAKAKALKAKKAVLNGVHSHKKKIHTSPTFRRPKTLRLRRQPEYPRKSTPRKNKLDHYAIIKFPLTTESAMKKIEDNNTLVFIVVVKANKHQIKQAVKYLYDIDVAKVNTLIRPDGEKKAYVRLAPDYDALDVVNKIGII

SEQ ID NO: 778681 - protein, 163 aa, Homo sapiens
MGGLATPDPSQACSLIHEMELGQGGHRKALQTVKCSAYVGVPVASPEPVGNTLQSRPGPGRTPSCASRPWPQGPHLGQQEQGAAGAGVRVALPQVEELGRHDGGREEAQAQEAGDGDERYILEGCGRARAGVPQTRAPGQPPPLGSVPDPRRDNSSLGPPQRS

SEQ ID NO: 778682 - protein, 32 aa, Homo sapiens
MVELLDLYQMEDEAYSSLAEATTELYQYLLQP

SEQ ID NO: 778683 - protein, 105 aa, Homo sapiens [sequence omitted]

SEQ ID NO: 778684 - protein, 113 aa, Homo sapiens
ATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSAVQA

SEQ ID NO: 778685 - protein, 309 aa, Homo sapiens
MPPHLTNFCIFCRDGVLLCCPRLVLNSWVQAIHPPQPPTVLGLQTFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 778686 - protein, 354 aa, Homo sapiens
ATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 778687 - protein, 309 aa, Homo sapiens; identical to SEQ ID NO: 778685

SEQ ID NO: 778688 - protein, 249 aa, Homo sapiens
MANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 778689 - protein, 309 aa, Homo sapiens; identical to SEQ ID NO: 778685

SEQ ID NO: 778690 - protein, 243 aa, Homo sapiens
ISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 778691 - protein, 200 aa, Homo sapiens
ISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTGE

SEQ ID NO: 778692 - protein, 112 aa, Homo sapiens
VQDSVRAGPRQGLGHGKISNRAGARPVTGPESGQGPEQCKARVGPGISGSGPGENQGKFSSREWPGPGQVQGRAMTGPGAALGQGQGHSKVRVRAKARVGTGQEIWHDQGQC

SEQ ID NO: 778693 - protein, 138 aa, Homo sapiens
MLEKWRETEEARGLLTRTQPTASGPPCSHAHSQLLLDRLKGNLARRGGVGRASLETVLWRPGETAFYPQHWGEQASIPAFACRPSSFPLKAYPAAPALRNALLSYQLWERQDRLASGRRGRHCLPSGPGPHRYPQLQD

SEQ ID NO: 778694 - protein, 118 aa, Homo sapiens
ACESSKLPLCISLSLSSSRTQGHTPAGSYSFIPTSLQSAPGCHLLKSEALLLSGAIEEHHSILNSTSYGPKGFRDSMTPPSLTKLSKFPTLHLPAPPGYLCSVELSMSHLFTNLWSKV

SEQ ID NO: 778695 - protein, 92 aa, Homo sapiens
MEERENKVIWESKMKGFETSEEECVYLFSLVTSSSALSTSSSQASPGRFITALVPHIWSLTELLLFENSSECLLHFTLSSPSQWLWLKFTLQ

SEQ ID NO: 778696 - protein, 110 aa, Homo sapiens
PASAARSRGSQPCLPFHTSPQAEGAGSGLGHPRKGLPQCSGGLKGSSSAARVGAEAKGAPRPRRRLERARAARAASMLSPLTTMLRTSLSHHMSGRKEEPLARLCLLPAL

SEQ ID NO: 778697 - protein, 101 aa, Homo sapiens
HKGSCLPRDLRAEGQTRQGKMTADRAEEAASRLQAPGKPPQLYPLHRWRAENGLGQGAALPSPVRPVFSLQPTERENGEVVGGNKAHTTQLTWAGQARAGR

SEQ ID NO: 778698 - protein, 106 aa, Homo sapiens
MDSSGYEDGLGVLFVFVFVFFEIGSRCVIQAGLELLGSRDPPTSASRVAGTTGMSHPTWLVWGFFVGFTFFLSELFEGRIQEAQTICQLWLKIFISFPASTVPNTE

SEQ ID NO: 778699 - protein, 36 aa, Homo sapiens
LHASGMILVKTNPINSGPPPAQNSSHTSIIIMMEPK

SEQ ID NO: 778700 - protein, 43 aa, Homo sapiens
LKEPHTYRGPSAVHGDTGQPRRGKTTLPFENMVVPMYQDKVQG

SEQ ID NO: 778701 - protein, 112 aa, Homo sapiens
TISQFCIILWFTRGEGPQLLLESTWEGHLWTPSLCLPFLPPSSFLEGWCLISEALDISSSSSFRLFRAFGRRAFLLPTLTASCGKMSQHYYLITRVFLQLIKDLPAPDKESG

SEQ ID NO: 778702 - protein, 245 aa, Homo sapiens
SGESREVGSTSCGKELPTVRLLNLLGQPSCGKERQPSCRKELPASGLLRAVLPLNKALLHLAKPPFVRNTSSPWTQDKNSGPAWRTDIQTWSKLDCKGPTSEMDAVCKRGNLWKDVLLQLLKMQHAAQVLLQTTDNSEVNTQSGKPSGGETREHQAEKAGRSFFRELVCLPEKLARHSSIDRFLQLELISLECSESYPSRDLVRNQSMHRFNMGSAQQPVSKLSVKVCRDQQGVGDFSLNPPLEP

SEQ ID NO: 778703 - protein, 70 aa, Homo sapiens
ARSGLGPGQSRRSAFMSAWGGRKSVLCPSPPGMDSGVYGCGDSPGLTQARVSTTGPRISLTWRRPFCDGS

SEQ ID NO: 778704 - protein, 38 aa, Homo sapiens
TFSAFVTLKSKFSLYDLAFAYSFKLILSHSPSYIIPQT

SEQ ID NO: 778705 - protein, 83 aa, Homo sapiens
ALEDPEGAGWVCCAHSGWHWVNPQETCGQGTNGHPLYAHHVFRLSKQFFKVDVSIPILQMRKLRLRYVEEHALTRTANKRQKR

SEQ ID NO: 778706 - protein, 355 aa, Homo sapiens
ETTTKPQATSAPSPAPKQSFLFGTQNTSPSSPAAPAASSASPMFKPIFTAPPKSEKEGLTPPGPSVSATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAARPVWTKPDWFRSDRGWQCDPSATWGPAPVGEADRSGR

SEQ ID NO: 778707 - protein, 122 aa, Homo sapiens
DPTPRATQRPELEARGSGGCRAVSFAGPPPPLLKGRGALRACGCSEDGEAETHSEDGPGSPQASVPRALPSPGSPPGSSASPAPRAHFPTRFLESGWETRRQTLPSSALLGPQTPERRSGSP

SEQ ID NO: 778708 - protein, 91 aa, Homo sapiens
DALLQPELGLFSHWEKGCGSEELGCRNFGVYKGRRELSQKSLFAGRREMQPGGTAGPCGRQRPGLLKSASQTHLAASRRPLRAQLFLPAAS

SEQ ID NO: 778709 - protein, 105 aa, Homo sapiens
MELGATQSLSSGVGGLAGRHRGLDGWASHSSVCVSCAQTLCVSSPSHTDSPIGLTCFLFVALMVSSEGGCVGGCMCGVCMCVYACVWRVCACVCVCMCACVCMFV

SEQ ID NO: 778710 - protein, 103 aa, Homo sapiens
WDRGGTLLASSQLLGLRWDALGDLWILCSVEETWEMPFCDLWIPWEKTLSKFGPQEELFIQCLVYLSLFTALKLGIQFQLLSRLVTLEILPCILNLAKSKVNQ

SEQ ID NO: 778711 - protein, 976 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 778712 - protein, 171 aa, Homo sapiens
NKRNEKRNSLNEPRGRMEKLKREAKENTATLKEKKDKKTQTFLLETPEIYWKLDSKAVPSQTVSRNFTSVDHGISKDKRDYLWTSAKNTLSTPLPKSMVSEEETLKTLYRNNNPPASHLCVKTPKKAPSSLTTPGSTLKFGAIRKMREDRWAVIAKMDRKKKLKEAEKLFV

SEQ ID NO: 778713 - protein, 171 aa, Homo sapiens; identical to SEQ ID NO: 778712

SEQ ID NO: 778714 - protein, 869 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKSMVSEEETLKTLYRNNNPPASHLCVKTPKKAPSSLTTPGSTLKFGAIRKMREDRWAVIAKMDRKKKLKEAEKLFV

SEQ ID NO: 778715 - protein, 869 aa, Homo sapiens; identical to SEQ ID NO: 778714

SEQ ID NO: 778716 - protein, 173 aa, Homo sapiens
SFNISQYSFPRPSVPFSPQEKLKREAKENTATLKEKKDKKTQTFLLETPEIYWKLDSKAVPSQTVSRNFTSVDHGISKDKRDYLWTSAKNTLSTPLPKSMVSEEETLKTLYRNNNPPASHLCVKTPKKAPSSLTTPGSTLKFGAIRKMREDRWAVIAKMDRKKKLKEAEKLFV

SEQ ID NO: 778717 - protein, 269 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVF

SEQ ID NO: 778718 - protein, 204 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKLPAMS

SEQ ID NO: 778719 - protein, 171 aa, Homo sapiens; identical to SEQ ID NO: 778712

SEQ ID NO: 778720 - protein, 976 aa, Homo sapiens; identical to SEQ ID NO: 778711

SEQ ID NO: 778721 - protein, 112 aa, Homo sapiens
LYLIIPCLSLPFLFAPQEKLKREAKENTATLKEKKDKSMVSEEETLKTLYRNNNPPASHLCVKTPKKAPSSLTTPGSTLKFGAIRKMREDRWAVIAKMDRKKKLKEAEKLFV

SEQ ID NO: 778722 - protein, 211 aa, Homo sapiens
SRVRPEQRGRARRAWPEPPLPGVSSAEPRAPRAGISARSPPLPAPSLSPACKVFCLSSELAEAATFHSRRRGPGSSGRAGQRSARRAAPRCAPPPTMSEDSRGDSRAESAKDLEKQLRLRVCVLSELQKTERDYVGTLEFLVSVSVPGRRRGTSRAARGAGPGVAAGRTRGIVCAGTRDGSGHHRRGNPRVDSAFAGAVTPAGIRWCPETH

SEQ ID NO: 778723 - protein, 103 aa, Homo sapiens [sequence omitted]

SEQ ID NO: 778724 - protein, 177 aa, Homo sapiens
MSADFCSSCMTRPLFSVTSWVRRRFCSFSIRIVCCCHPGKEVNVRAGQRGPEEDVGRARLAPAAASNSPTHRATSCTLGSSRPSGWGLPAGPKSALALLWPRRHWRSCTGCSRCWYQSRPRHHLQTLQQHHLLLLQLLHLLQQAAVHAAGDGEPPTSLRARGASRTSRVHLQGPAGQ

SEQ ID NO: 778725 - protein, 179 aa, Homo sapiens
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGRSRFKPVPWAEVSNPIRMVGALFQG

SEQ ID NO: 778726 - protein, 130 aa, Homo sapiens
MLNKFQYTFVLGFYVTLVVNRWWNQFVNLPWPDRLMFLISSSVHGSDEHGRLLRRTLMRYVNLTSLLIFRSVSTAVYKRFPTMDHVVEAESHYVAYAGLELLASSNLPTIASQRAGISGVSHHTWPALES

SEQ ID NO: 778727 - protein, 241 aa, Homo sapiens
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGKQMPKNEWKMEDIKIPLPQPQFQCAKSDPGG

SEQ ID NO: 778728 - protein, 145 aa, Homo sapiens
QNQKIWIIIYFCPPTSKKAENSAKSISVTNVSAVRNCFIISCYSTGFYVTLVVNRWWNQFVNLPWPDRLMFLISSSVHGSDEHGRLLRRTLMRYVNLTSLLIFRSVSTAVYKRFPTMDHVVEAGTMNGFSFHGLFSAETGPPEFL

SEQ ID NO: 778729 - protein, 141 aa, Homo sapiens
QNQKIWIIIYFCPPTSKKAENSAKSISVTNVSAVRNCFIISCYSTGFYVTLVVNRWWNQFVNLPWPDRLMFLISSSVHGSDEHGRLLRRTLMRYVNLTSLLIFRSVSTAVYKRFPTMDHVVEAERTGMKPILPSSFEMQSF

SEQ ID NO: 778730 - protein, 72 aa, Homo sapiens
MFLISSSVHGSDEHGRLLRRTLMRYVNLTSLLIFRSVSTAVYKRFPTMDHVVEAERTGMKPILPSSFEMQSF

SEQ ID NO: 778731 - protein, 220 aa, Homo sapiens
SRKVRAGIMAGARRRRRRLAELTVDEFLASGFDSKSEYSPEAETREAREAARSPDEPGGSPSASRRKGCASEHKDQLSRLKDRDPEFYKFLQENDQSQLNFSDSDSSEEEEEPFNSLPDVLEEASEDEDGAEEGEDGDRVPRGLKGKNCVPVTLAMVERWKQAAKQHLTPKLFHEVVQAFGAAVATTQGDQEIAEANKFQVRDSAVFNALVTFCIRDLIG

SEQ ID NO: 778732 - protein, 103 aa, Homo sapiens
RLRGGHHCVLGCQGKGGVRAVSRRALMTHPARKFCMLLWPQTPLLLSVPVRLLSSRWPGTAGKPSPARAWAAFSWWLEFPHSKTIWGILLKCLCKANVVAVAG

SEQ ID NO: 778733 - protein, 74 aa, Homo sapiens
PGQGWGGRGPAWPSGRAWTLGPEICCFCFLGSSPFPPPREGGKRMTVVVLFKKEKEAHAVSKPKAELLTSNISS

SEQ ID NO: 778734 - protein, 100 aa, Homo sapiens
MACVLIPISTCHVTLRKFLNYLSFYTLIYKMGLMLILTSKGCCIKLINICEVSRKSPGTLNTNFCCNLNRCPWSHFVLLLAIFLPQEHLRTHPPIPASLP

SEQ ID NO: 778735 - protein, 236 aa, Homo sapiens
DVYSITFLVDWHLCGQRNNTMFSKRLEKIPQVPLLFPFIFIILTNYSKMEGAVESQPSFFKTSQDIVTCTWVENCYSSFSRRPLEQMFCKHQSKNIISWTGMVAHTCNPSTLGGQGLCDFAKMHHQQRMAALGTDKELSDLLDFSAMFSPPVSSGKQWTNFFGKWTFYWLKVEDRSSSGSWGNGGHPSPSRNYGDGTPYDHMTSRDLGSHDDLSPPLSIPEYKVKPERGHTHLMGE

SEQ ID NO: 778736 - protein, 80 aa, Homo sapiens
LERTGGEQLGGRGGTPRAPVFEPSSGSGSHVRQDTDEVVLAAGLGGEPRKAGSTIPSRKTPNLPYVLLEGWQGLGDNGRL

SEQ ID NO: 778737 - protein, 126 aa, Homo sapiens
ERRVRETVRRDKTLLKEKRKRARKARLLVSSLMFLPRASMNPWHVLAPDILGTEPSSSPWIRPSTTHCPFLPLLGQKDSLVVPRCTRCFHAPGPLHMPFFQSGMSPFSPSFKLLSILWAAWADAGG

SEQ ID NO: 778738 - protein, 71 aa, Homo sapiens
SCPCSFWCLKILTIVVEPCICGKKLPVSGEDTEDIAGLFSENEELGKMRSSLIENTETYMSMRRPFAEYPV

SEQ ID NO: 778739 - protein, 49 aa, Homo sapiens
MLTKCYRNTAMPCHLHIACGCFHITMAGCRGTTETLGPKAKQMDYLTLN

SEQ ID NO: 778740 - protein, 512 aa, Homo sapiens
RCLTLAKREGDPISGESVRGEGEPAGQALRITHPVTLPCPPPPSEPLATMATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPSHRRHAGLLSLPDISLEALQKKKAMLQEQVLKTALVLGVIQALPVPGLAAAYDDALLIHSLRGYHRSFGLDDDSLAKLAEQVGKQAGDLRSVIRSPLANEVSPETVLRLYSQSSDGAMRVARAFERGIPVFGTLVAGGISFGAVYTMLQGCLNEMAEDAQRVRIKALEDDEPQPEVSLEVASDNGVEKGGSGEGGGEEAPLSTCRKLGLLLKYILDSWKKHDSEEK

SEQ ID NO: 778741 - protein, 162 aa, Homo sapiens
RCLTLAKREGDPISGESVRGEGEPAGQALRITHPVTLPCPPPPSEPLATMATSKLPVVPGEEENTILMAKERLEALRTAFESGDLPQAASHLQELLASTESIRLEVGVTGESGAGKSSLINALRGLEAEDPGAALTGVMETTMQPPPCLTHKLSLNKIQITN

SEQ ID NO: 778742 - protein, 500 aa, Homo sapiens
MPRPRRCEWLPSPLQALRITHPVTLPCPPPPSEPLATMATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPSHRRHAGLLSLPDISLEALQKKKAMLQEQVLKTALVLGVIQALPVPGLAAAYDDALLIHSLRGYHRSFGLDDDSLAKLAEQVGKQAGDLRSVIRSPLANEVSPETVLRLYSQSSDGAMRVARAFERGIPVFGTLVAGGISFGAVYTMLQGCLNEMAEDAQRVRIKALEDDEPQPEVSLEVASDNGVEKGGSGEGGGEEAPLSTCRKLGLLLKYILDSWKKHDSEEK

SEQ ID NO: 778743 - protein, 72 aa, Homo sapiens
NWVCEVLFSSGGKFILSCADDKTLHVWDYKNRQCMKTLNAYEHFVTSLDFHKTAPYVVTGSVAQTVKVWECR

SEQ ID NO: 778744 - protein, 163 aa, Homo sapiens
PAVFWNKCQFFLGASVFQSRSWLFSSKAGVSPGSTACWRRRILFRGSTGRFMEWPVSHSHCAGWQLFRGGAALSRFPWFSVSAVPVPAFVAVFLSQSSLCFFDDNAIHFSKTGYVWNWQFFFVRVLGFAEPVVPGYWTAVCSVLAMLHPVPLGAPCWSFETAF

SEQ ID NO: 778745 - protein, 68 aa, Homo sapiens
TTQPSSAGLSLPLSPHVASQAPPVFLLCHSWAQEPPQTATGHTRPLGSICPNHRMFQSNLCCSRGSGT

SEQ ID NO: 778746 - protein, 241 aa, Homo sapiens
MRGLGAARSGVADVDSWTLLGASALCRLVDAFGENLCSPQLQGQHAFLASSDQGGCSWVLHQNSSSGLSSSGRLTIIPAKTQVRVLTVLPSFLRVSVGCAESGPRCVRGCVHCHRSLYTSRRGPRAELGPRGPSRRAAMDPGLSCDHEGYPDELAVDPGLSRDHEEPSRNCDCFLNVEASAERGPWRTLAAENDAHSAAWPRLPIPSANSQDRIDGESPGETKLTLVTSPTGGSGTGPGPV

SEQ ID NO: 778747 - protein, 114 aa, Homo sapiens
RSRGADSLPSGVIAGGSAAFQGLFVERTEGNPEGGRQGSWPQVACVPCHQEHKAVGAQGSGQELPISELVLLGLEATDSGLAKAARAGKGMVAFGAGVEEGGQLVGPVSLEPVR

SEQ ID NO: 778748 - protein, 81 aa, Homo sapiens
PDVGGGWVLDVAEKSRGLGVVRAACRLRRCCQVAPVLHLTLWGCAACVSQCCVLKRQTGGKVEGSTRGVHCPLPAHGVPQT

SEQ ID NO: 778749 - protein, 55 aa, Homo sapiens
VGEQTRSEPVCFGARVKESAKQLSQFHVDMFIHIIFTALTSNKKRPESTWMCTEP

SEQ ID NO: 778750 - protein, 121 aa, Homo sapiens
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGEA

SEQ ID NO: 778751 - protein, 110 aa, Homo sapiens
WSPYLLKPSSPTGSSWCPPCLHSGLQFPIVRIPFSSWQDSLLSPSRFSLSSMFFSVSGGCVLPLPCLAAGSRQVPPGLFVSSMTFQKHPATSLSYRDKCPFQSTDWSMPM

SEQ ID NO: 778752 - protein, 158 aa, Homo sapiens
MVTVHPETGSASSPITQHMSSGIMCAKNLYREGFEGMSDLKCVQDAKGGSFYRDHCPVLGEQNGNRNPGGLQIGDLVNIDLDLEIVQSLQHGHGGWTDGMFETLTTTGTVCGIDEDHDIVVQYPSGNRWTFNPAVLTKANIVRSGDAAQGAQRGTSQL

SEQ ID NO: 778753 - protein, 83 aa, Homo sapiens
NRCPRPTRRGSATLGLTWLGSATLGFPRLPLGLSAALRAPQPFWPSRGSQFSWYVLPAGISGLLEDPRPGEGMSQGHARSRPQ

SEQ ID NO: 778754 - protein, 104 aa, Homo sapiens
LEPGRWEVCSELKSHHCTPAWATEQDLVSKQKGKEKFLEFVKFFPVSHCLPCFLYQKCRPLISDGSYSKFSHYVGPMHMSSKLVSSFSFLLQCHFLIEPFSDLP

SEQ ID NO: 778755 - protein, 194 aa, Homo sapiens
RGYCGDRQSSLGAMLEPGATPQRYLGLVLGEPRRVVAALPESMRLDSNPHGFPWEMVICAAVAAFFAVLLFLWRSFRSVRSRLYVGREKKLAIMLSGLIEEKCKLLEKFSLVQKEYEDYEVASSLEDASFEKAAAEARSLEATCEKLNRSNSELEHEILCLEKELKEEKSKHSQQNELMADISKTIQPLADESE

SEQ ID NO: 778756 - protein, 174 aa, Homo sapiens
SPPPLSLPSSRGGVAAPAGGRMVATWGGRQLLPQGSGPPLTPGSPAPSVAQASRPAPPSPRKTSPGPPQPSASPSLPFSPLLAGCSRLLPVLAPSLSSVHRCPLGARASRLPWKLEAGTSSSGDRPLCLHSGQRGACLTDEQGSTLSPRQRRGPGSSLAQPLTEAGLETGALEK

SEQ ID NO: 778757 - protein, 112 aa, Homo sapiens
EPGKGLGLGQGQEQGRAGPGPWQSQGRSLTGPGSRPGPGQQQGQGLDKGRARDMAGPGLGPGPGHSEGRAKAKAGSGQVQGRSRERPAPSGAKAQPAQGKAGQWHHWAMTGQ

SEQ ID NO: 778758 - protein, 126 aa, Homo sapiens [sequence omitted]

SEQ ID NO: 778759 - protein, 69 aa, Homo sapiens
SQKQPPDNFAYISLARTSPRGCRWLENLIFILGGHVQLKVLLLFIEFGQEPAVCAMGGRRDQQSPLTWN

SEQ ID NO: 778760 - protein, 40 aa, Homo sapiens
MIWNTAAKARRPPITLRKTSIWGTHRTKKERMKQITRMLT

SEQ ID NO: 778761 - protein, 115 aa, Homo sapiens
PIIISQNTHFHLYLPNTIFCISKPLKLQSRSKYQWVYMKLLCHQKFTMERCYFWYPSCKTMMPVFFFLRQSLILSPRLESDGVISAHFNTHFTGSSNSPVSAPRVVGITGMCHDA

SEQ ID NO: 778762 - protein, 35 aa, Homo sapiens
MARKTAEERTHKHNRLITESTLLLLENSSPSEPTI

SEQ ID NO: 778763 - protein, 50 aa, Homo sapiens
RVGKIAGMRSEARWQPPPAGPSSWLEPKIPEAGSPTQGAQAPQARLLQPR

SEQ ID NO: 778764 - protein, 212 aa, Homo sapiens
MTLVILLVELGGSQARFPLFWRNFPITFACYAALLCLSASIIYPTTYLQFLSHGRSRDHAIAAIVFSGIACVAYATEVTWTRARPGEITDYMASELGLLKVLETFVACLIFVFINSPYVYHNRPALEWWVAVYALCFVLAALTILLSLGHCTNMLPIRFPSFLLGLALLSVLLYATALVLWPLYQFNEKYGVQPWQTRDVSCSDRNPYLQPQ

SEQ ID NO: 778765 - protein, 72 aa, Homo sapiens
SGTAVTNSHEGGSAFSNMSLSMGAPRHKSRSASRLVVAEVVFQHQPSSPAHQSWHSTQVNSKNPTDGVRSRI

SEQ ID NO: 778766 - protein, 157 aa, Homo sapiens
MGDIFLCKKVESPKKNLRESKQREEDDEDPDLIYVGVEHVHRDAEVLFVGMISNSKPVVSNILNRVTPGSKSRRKKGHFRQYPAHVSQPANHVTSMAKAIMPVSLSEGRSTDSPVTMKSSSEPGYKMSSPQVVSPNYSDSLPPGTQCLVGAMVSGGG

SEQ ID NO: 778767 - protein, 216 aa, Homo sapiens
TRKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQVRRVNK

SEQ ID NO: 778768 - protein, 71 aa, Homo sapiens
LAWRGWTGFETRLWALLAPGQRFPSRLPIEITWEVNITYPGPQPRLIQGSVRSARILKNSQVTLTARDGNP

SEQ ID NO: 778769 - protein, 129 aa, Homo sapiens [sequence omitted]

SEQ ID NO: 778770 - protein, 743 aa, Homo sapiens
MVKSAYAVKGSLLGIFKMGLCKVLENTCHATMPLWQEDGLEASIEVFHLKVLYFGSTRHEFIKWWSGNIVCLCKPARFEEIENTANKELRHNGLCTKLKDLGFTVSLLLAARLSSLPGRKSPVNGLNVDRLNFVYRVGGHRREDTCKYLSPKYLFVNHSLLSFFFFPLEIQLGLLCKTHFFLLEGQIIVEKTQQIPHTILPQKDSKPLSIMENKFLYTFSNVLTCNILMLDLIFTSCLIIHLHLDRKSVFSSVIFSLKMSVKSKGHLLPFEKYSFSLNPLDISSLHICYFAITFSFMDYVVSRMVPCGSKSSQEMNGVKIPKLEVVLVFISYRGKIILCPYAEIHEADFFLYTRSDELEMTAWMAALRLAIYDSQEKVCTNLGCVSWVRGWAVSCISLSFFRSLFQDVTAILHPPTFLAEKVAWPWVCGNNFCPAPSSSFPYILPETDGYSIPVHFPNKEVQLLAWIEKPRQCDDVLIKINIYLQAFPLSLRGVLVTKEVQVAAVFALGEFSEARVIPQPVNGDKLQAADWAAVVGREECVIPCQRLMGIVSVVVIFPILCSHFDRGCGLSQTWILFPRTPVASWIKCKRSFLGTPIPNSTMSVRRILSTFLTYAFPWLSLWSPNGYSLCCMLFSCKALKILISFLFLSSIEIYLEIYFKSALKSLCRLYREFCVIIIREVIKVQVYFNIYIENTINQMHINTPTQYPSLLSLHDRSSCESKPGKTWPLKLYIICTQSLNDLH

SEQ ID NO: 778771 - protein, 184 aa, Homo sapiens
VPKAACGPAITPWVLSHLAVGVRWWKGTLREAPGGELSLGRGRPRGQCGVDGARKNPERSQATRHRFRRIVRSHLSRRLRSRRLLFPGAASLEALPGGEAPTRAPYVPPSAALRTTRMSRCLGLEPVTPPLRTGLQSNKYFAGQRCRPRVLRREVLSLEPTKTCPQDSLSLPDCVPPDGAFRLF

SEQ ID NO: 778772 - protein, 135 aa, Homo sapiens
MAGQRAARQACAFRQTLTKTSQTNEHGVRNMAESRPQIPDMAVGERRPGLHLRRARASSELLCGQGGLIHPCIPTPSPVQKHLLNEHMNDNMNEITVYCPIPGVYEKQRERNSKILLHRSSLPCSTPGLTTALGP

SEQ ID NO: 778773 - protein, 34 aa, Homo sapiens
GVCHIFASFNDTFVHVTDLSGKEIICRVTGRMKV

SEQ ID NO: 778774 - protein, 187 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKGAKGPSAQAQCSSPHSGLRCGMNELVGKLEGKKWAGILVHLWSRN

SEQ ID NO: 778775 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 778776 - protein, 198 aa, Homo sapiens [sequence omitted]

SEQ ID NO: 778777 - protein, 145 aa, Homo sapiens; identical to SEQ ID NO: 778775

SEQ ID NO: 778778 - protein, 97 aa, Homo sapiens
MSLSVNHEKYDDKRSRSSAMTSCNIICLEHPCVKVIHDNFVYRGRTHDQQSMPSSGTQKTVDGPSGETVGVMGGGSPEHHPCLYWAAVLWAGSFPEL

SEQ ID NO: 778779 - protein, 230 aa, Homo sapiens
MSGALDVLQMKEEDVLKFLAAGTHLGSTNLDFQMEQYIYKRKSDGVYIINLKRTWEKLLLAACAVVAIENPAHVSVKSSRNTGQRAVLKFAAATGATPIAGRFTPGTFTNEIQAAFWEPRLLVVTDPRADHQPLTEASYVNLPTIALCNTDSPLCCVDIAIPCNSKGAHSVGLMWWMLAWEVLRMHGTISREHPWEVMPDLYFYRDPGEIEKEEQAAAEKAVTEEEFQGE

SEQ ID NO: 778780 - protein, 175 aa, Homo sapiens
RPAEEGEGARSARCSRVLSRRSRDRPVCARGAGSRGTDGRARASARGVRVRVGGPGRREVRAGGPRGSRTDTSAHTPGGAFEAALPRPDGERHCLPAQRSLAPRLPPRRLLLLGTASPSAAPGRAGGGGGGGGTRGAALCAARLGAAAQPPDRGPGARCTFRPHEEERRLKDCEP

SEQ ID NO: 778781 - protein, 101 aa, Homo sapiens
KKQPTLIPSSTVQRPQALQETELVLYKHWKLPPGGDSCPQYLPKPQAGPCVQVTRRGLGQGVWPVEPLCHLGGHEQLVVVSRVGRIGFPVLGDSSSPCLLC

SEQ ID NO: 778782 - protein, 138 aa, Homo sapiens
SFPPGNTTRLHFPATLQLGETHETSPCQWNVNGSASNFLAHENSSIFSIFFFSFFVFFRRSLALVAEAGVQWRDLGSLQPPPPGFKQFSYLSLPSSWDYRHVPQCLANFVFLVETGFLHVCQAGLKLPTSGNQPASAS

SEQ ID NO: 778783 - protein, 131 aa, Homo sapiens [sequence omitted]

SEQ ID NO: 778784 - protein, 106 aa, Homo sapiens
MDHTQRYVQTDVQTLRHMHTAHVLADGHPCIQQGTHHPLAHSGVRHILNILRHACHAGHTLQHTDRIPTHAQLASYDAHTLQTNMHRFSCLSHDSQMVGFSQRAAI

SEQ ID NO: 778785 - protein, 122 aa, Homo sapiens
ISQTSGSDRGGRLPGAPRPTCRLPRPSPAHSCQAPDRSPGGTRSERPRSPAAWSPARCSGWPSQTRRRKPPPTKARAGRRWRRLWRPRQRWPQLNIFFSKAYHSFSFAAAISSIIICCGWVK

SEQ ID NO: 778786 - protein, 107 aa, Homo sapiens
VTLRITSGRFGSQPDPVRHSISSSSVHIELPRAKMNMTQSPLLSGNSVVGLRGHVSQLQTEFWGGKCCRGGRQLVEGRGVTTEPPRSLGRLHGAGEKPAGVEGQGGG

SEQ ID NO: 778787 - protein, 110 aa, Homo sapiens
VTCLVRLLAGSHTMMDGPWRLERLTQWLLLLSAITLILDQLAAAVMDSVTMDMCVSVLWELSRGTSLRDGNRCWWPGKYPHYSTSGGSLEAGSEFAKWKRHRGTRWISMG

SEQ ID NO: 778788 - protein, 494 aa, Homo sapiens
SFSSTWGRRMAAAVADEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGKKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 778789 - protein, 333 aa, Homo sapiens
DRPARKSDEAAAAVSDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGKKLASGCKNGQILLWDPSTGKQVGRTLAGHSKWITGLSWEPLHANPECRYVASSSKDGSVRIWDTTAGRCERILTGHTQSVTCLRWEDGPNLAPDGHKLDQTGGDWSRPGTGPDDPAATGRYQQAQGSRNRAEGGTPGRKRRQRLKQRNPAPRANS

SEQ ID NO: 778790 - protein, 494 aa, Homo sapiens; identical to SEQ ID NO: 778788

SEQ ID NO: 778791 - protein, 540 aa, Homo sapiens
SLSPPRGDAGWRQQWRWVCVDGGGGRRRGALGPGSLRPERGEVGPFWAGDQTDSRPTCSLQDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGKKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 778792 - protein, 504 aa, Homo sapiens
SFSSTWGRRMAAAVADEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYRTAADSWRGYLASGSGDTTVRFWDLSTETPHFTCKGHRHWVLSISWSPDGKKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 778793 - protein, 276 aa, Homo sapiens [sequence omitted]

SEQ ID NO: 778794 - protein, 262 aa, Homo sapiens
MRAGSCWVPRSTCPWTSPRTGCSSCATRYWPRYLASGSGDTTVRFWDLSTETPHFTCKGHRHWVLSISWSPDGKKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELNERLLNRYNSCGQVQKAVSGRDYFSWGPQEKP

SEQ ID NO: 778795 - protein, 74 aa, Homo sapiens
PLVSELRPGLDMKVWQQTVRTPGENPDSCANPTVSGSTLDAQTQQTARRQVQDIRFGKNGSRGGGGGGGHARRA

SEQ ID NO: 778796 - protein, 86 aa, Homo sapiens
GFSSPSTQSIKPWPLGGSGTPPERTITPSAPRRPGGLSGQPLWSVKEIEVHWKQQGPNSYSQPFSWNQQNMNPAGEGRTSYTRRPG

SEQ ID NO: 778797 - protein, 68 aa, Homo sapiens
SEALAANRLPKQSQPVYGSIDWEPSGSPRELVPSVPSNEQLTSSMGDSGKSQALSGGLATAQVPQGDV

SEQ ID NO: 778798 - protein, 87 aa, Homo sapiens
RGVSCVGLCVQGCVCIAVCVQGCVRAGVCACAHLFMFLCTCLHICVYRGVYRCVYVCMSVCASVCMSVCVCVCVRVGHAGMYVCMQV

SEQ ID NO: 778799 - protein, 87 aa, Homo sapiens; identical to SEQ ID NO: 778798

SEQ ID NO: 778800 - protein, 325 aa, Homo sapiens
MAQYKGTMREAGRAMHLLKKRERQREQMEVLKQRIAEETILKSQVDKRFSAHYDAVEAELKSSTVGLVTLNDMKARQEALVRERERQLAKRQHLEEQRLQQERQREQEQRRERKRKISCLSFALDDLDDQADAAEARRAGNLGKNPDVDTSFLPDRDREEEENRLREELRQEWEAQREKVKDEEMEVTFSYWDGSGHRRTVRVRKGNTVQQFLKKALQGLRKDFLELRSAGVEQLMFIKEDLILPHYHTFYDFIIARARGKSGPLFSFDVHDDVRLLSDATMEKDESHAGKVVLRSWYEKNKHIFPASRWEAYDPEKKWDKYTIR

SEQ ID NO: 778801 - protein, 325 aa, Homo sapiens; identical to SEQ ID NO: 778800

SEQ ID NO: 778802 - protein, 73 aa, Homo sapiens
LSGSPGSSHFPVVSAHILLRIFPPDTCTPGFALTHAPLLPRESFAFISGGVRFPCFLWHPVETRGTLALCGYS

SEQ ID NO: 778803 - protein, 71 aa, Homo sapiens
EATVPRKKGMEEQRVQFTLWLHFSPHGICQFESGRQEAKKLKGSGQPLKTGEIKTGIQKYRREALVNTPNS

SEQ ID NO: 778804 - protein, 194 aa, Homo sapiens
MSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELE

SEQ ID NO: 778805 - protein, 112 aa, Homo sapiens
QPFPGRSSLFTLPCWGEGRASQGTWPHKGHSEMSPSGQGCQETAIALLEEGQETMTIDRSLQPLLGEFGCFFGLVLIFPGLTSVIQLDLQCWLKLLLETRARPGMWAPLASL

SEQ ID NO: 778806 - protein, 106 aa, Homo sapiens
LSPHPLILHVSKLLGSAFKIPEFTLSHPHCCSLPSSPSLAWSTTEPPAAPALPCPCTCQSEQRHPSRPCSLPHGFLPWTGLCGAGLPVWGLHVDFVHPASQDGSPR

SEQ ID NO: 778807 - protein, 55 aa, Homo sapiens
KRQAEKRGGCGRSEDSILEILDSKGNPPHFACTYGTPSKSSPRLPNTRSRHPLPA

SEQ ID NO: 778808 - protein, 35 aa, Homo sapiens
MVRVHSEKSAPHHKILENILHPSHPAVLSPQALLS

SEQ ID NO: 778809 - protein, 118 aa, Homo sapiens
MATRVPNLCHTPSLDAHILSNFGHQPNGTTVMFMHSTLCGFLEHQGVATPKALGTKNKQQTTHSLHVALPIIVTLNPGSTLESAGEVSKLLKPESYPRLPGDCIQGECCSCSPGGSPG

SEQ ID NO: 778810 - protein, 86 aa, Homo sapiens
MAPLGTWERAWAECIASAGAPLLLQPVLLSPVGDPAPPGASLPKGHTLLDANRQSKKGASKRAMETSHLLGKERVGQNHRAVSAVL

SEQ ID NO: 778811 - protein, 116 aa, Homo sapiens [sequence omitted]

SEQ ID NO: 778812 - protein, 81 aa, Homo sapiens
CLVKSWKLPKFLKSGDAAIVDMVPVQAQCVLRASQAIHLWVALLVRDMRQTVAVGVIKAVDKKAAGAGKVTKSAQKAQKAK

SEQ ID NO: 778813 - protein, 80 aa, Homo sapiens
EVHGLADVCAHIVADLAEVVATVFLHDMLDQQRPIAENLDSAIYGKAVILNCSAEGYPVPTIVWKFSKGAGVPQFQPIAL

SEQ ID NO: 778814 - protein, 113 aa, Homo sapiens
PWALGALAKTGEWASRVLLCEGQGKGVVARCLAEPSPFPTLSLTRPPVKGSEAQMSRAILNVRSCRPSATVTCASSAPQAPPLVSVTTGSPGGQMIAREFFGVRRFCCEKGED

SEQ ID NO: 778815 - protein, 58 aa, Homo sapiens
LKSKSPGGAKLCPACCCAFSCSGEACAAETMLGSQSNCAICYYKAYLGLGMVAHAYYP

SEQ ID NO: 778816 - protein, 55 aa, Homo sapiens
MASLCTRNTFLIMPCPVSEKDWRPHVRHWDRECTAKGQCLDFALCAWAWRILPLT

SEQ ID NO: 778817 - protein, 100 aa, Homo sapiens
CGVQEDEEVRGAENEEAGRDHVRRPGGPRRKEPRRPRRAQEEEAGMAQEEATAPSSDSSQLRIRPQQPRGILFSAIFTPTCCCLLCYSVFCNLRCLFNGE

SEQ ID NO: 778818 - protein, 105 aa, Homo sapiens
MSHHAWFTCKCVYVQFDATYRHQLPTCCSMQWAEPPTQNVAKNLQLSLFGRVLPKEGLASSLSASRRTCARRMEMSWCFSSDFYLEATRLSSGSPTSVAPALLFW

SEQ ID NO: 778819 - protein, 100 aa, Homo sapiens
SGDATAGPKEQGGGGQDPAAIAGHSAGGSDHAGERGLEEELDGWRRRRRRREVTVRPDLPPWAPDLGLGAGIRGSLSPSWAQRRVRTEIHARTLRGPVSC

SEQ ID NO: 778820 - protein, 112 aa, Homo sapiens
VLWIPGLLRRRLHPGVDDLRISPVCPTQPAAWSPKALSQNPRAVWRRPRVATGLKTEDPAPLSPQPGRPRLSPCSPHLDGTLHRRESPGLVSGSEFIQLPKIHVDMNVFSHN

SEQ ID NO: 778821 - protein, 106 aa, Homo sapiens
STRIAEHLGDSQSLGRMLADYRARGGRIQPKNSDPFAHSKDASSTSSGKSGSKNEGDEERGLILSDAVWSTKVDCLNPINHQRLCVLFSSSSAQSSNAPSACVSPW

SEQ ID NO: 778822 - protein, 202 aa, Homo sapiens
STRIAEHLGDSQSLGRMLADYRARGGRIQPKNSDPFAHSKDASSTSSGKSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMS

SEQ ID NO: 778823 - protein, 251 aa, Homo sapiens
STRIAEHLGDSQSLGRMLADYRARGGRIQPKNSDPFAHSKDASSTSSGKSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVNRPYYYILFAIYFFICMFFFFPEEKVSYMVLDSLFVIELYLSLLFYLPVLYVQSSIRFLKIPS

SEQ ID NO: 778824 - protein, 102 aa, Homo sapiens
RVCRARPEVALRAQRMGAEQHTARGGVSGSAALPGAGGRKPAEETHVPWVRERGASSSLHPPSARALSRPRPLTMHLPSKKGPHACQGREPRPQGHSSLEES

SEQ ID NO: 778825 - protein, 119 aa, Homo sapiens
MSAFTDTCFPTTARKNHGPGVTVIRGRGCGLHPERVAAAGPGAEDPVPGCDAGELQPPALCGLNCLLAWKAQLAQHKSFNRFSPRGCQVSKPAVISSLEQGKEPWMEEEEIRTWSFPES

SEQ ID NO: 778826 - protein, 159 aa, Homo sapiens
MSAFTDTCFPTTARKNHGPGVTVIRGRGCGLHPERVAAAGPGAEDPVPGCDAGELQPPALCGLNCLLAWKAQLAQHKSFNRFSPRGCQVSKPAVISSLEQGKEPWMEEEEIRTWSFPEEVWQVATQPDSQQQHEDQHLSHTFLDKKDWTGNELHECNEL

SEQ ID NO: 778827 - protein, 180 aa, Homo sapiens
AAFTQCFEVQDCNARTSGPQTLPTATDTSDTRCGGRRSGSGAVPSASVAGTHLLQSRHCTGVLGGGSSRRLCGLSGAAELGWGTLQVVGPEQRLAPHLTALPRTPPSSGSLCRAPATVTTWTQIPAFPQQQGRTMAQGSLSFGDVAVGFTRKEWQQLDLEQRTLYQDVMLENYSHLLSVG

SEQ ID NO: 778828 - protein, 79 aa, Homo sapiens
KARLAVGEQTRGHEPVLLSCYCIPAFPQQQGRTMAQGSLSFGDVAVGFTRKEWQQLDLEQRTLYQDVMLENYSHLLSVG

SEQ ID NO: 778829 - protein, 77 aa, Homo sapiens
TSTQPPSARTWGPVDNSWLQVQSVLARRRYQGCPYGPKSPQPPWLSLGALGTGSVPKLADVGGLWSHQGARGLWCKG

SEQ ID NO: 778830 - protein, 138 aa, Homo sapiens
MAVFTYLVCPVLRRARGQRFLCASLANPLTFPGGSKQLLICFFQSLSLWKLSPAANYTKGQTLDQTQRATRGPIKFYHGVILFLTVTQAIGAVLFWAPIGFGRSQMRLFGTRSTENLSPFETTSPSGSAFPNSFGPLI

SEQ ID NO: 778831 - protein, 92 aa, Homo sapiens
GAATLALSVLCGCLRVSASVRPLSSRTPRRAATLSQEPEVPALAAWTASHRPIKENLKNNFLYDFLYGGVGLTAPRECGRGAEQKNSRSEMK

SEQ ID NO: 778832 - protein, 228 aa, Homo sapiens
MCIGPRAELFLVVNICLIQKKTLRKELEEEMTEAITEAAVASSEEVSEERDDLGPLELHDSGTFQQVVNLLDIIDSESAKTDTTGAGLDMRKTLASVIIMEKATTEPSVVINTLIRCLQVPEISTQRKVNIYNILQDIIQQEGELEEQCVQRLVAIASKEMREIPEMEGYMKAEVASDTLVALSRNHFSLVMYELQHHLKPLNLTDEFVIITLAKLANGNGRGLRALS

SEQ ID NO: 778833 - protein, 110 aa, Homo sapiens
RLGGNWDLNGGQEVLSRESGLVKVSVSSFSYFSLNKTLLYTPFKPSVSLNFYGHGTDKDPVFIYTKEKSCNICGAQRGAREVENAYFGVKPGPPYELNRVCYSFNRLNKL

SEQ ID NO: 778834 - protein, 46 aa, Homo sapiens
MCQPQGYDPGDPHKSMGVHVGGPPSASFSTASPKGTPGSSTTETQR

SEQ ID NO: 778835 - protein, 35 aa, Homo sapiens
MPGIPVHRNAHQVRIPLAPPRRSDGLASFGISHCV

SEQ ID NO: 778836 - protein, 121 aa, Homo sapiens [sequence omitted]

SEQ ID NO: 778837 - protein, 68 aa, Homo sapiens
PTESDGFSLCQVPRSSAAASSEGSYPEGTAALYDNLFRRAQSPEKTNNLGPQPVWGTTGTSYPQILTG

SEQ ID NO: 778838 - protein, 112 aa, Homo sapiens
CVDFCSDLLLFFQCSYNLSHLAGGDVNIFFVHQLNHLDEVVDVDLAIYVSFSAARNYGVSKKVTKKPVFFTVIVAVVGLLASIRKWRMGNGKSHWITPPYITAFGFVVLTRQ

SEQ ID NO: 778839 - protein, 82 aa, Homo sapiens
MVDLLSMSQNISPYKNPMRFIFFSPILREEKFSSESCRNIGDISKSQPIGGSHQCVLEGTNIELLNSYSRNYGAVVKSWLGA

SEQ ID NO: 778840 - protein, 106 aa, Homo sapiens
MPRSLFMEPGMVDLLSMSQNISPYKNPMRFIFFSPILREEKFSSESCRNIGDISKSQPIGGSHQCVLEGTNIELLNSYSRNYGAVVKSWLGAYENGEGKDGPSLQS

SEQ ID NO: 778841 - protein, 218 aa, Homo sapiens
MGCVYSCCLEVCCGEDEIVYPRMPGESTVCHREREKPITYHWYHWHPGHIYPRVASMEDYDEDLVQEASSEDVLGVHMVDKDTERDIEMKRQIRRLRELHLYSTWKKYQEAMKTSLGVPQCERDEGSLGKPLCPPRDLSETLPGSVNEKGYAFHQEDPLEEFIQNHLPEASKSEVSSLLPMQTTGIQTNGDLEDLEGAWPRQTQTPEEATEVHLMEGD

SEQ ID NO: 778842 - protein, 127 aa, Homo sapiens
HPSRRGPAGVVASWTSSPAGRDGGVGIAGAWYFPRASSQAREMPQCPTLESQEGENSEEKGDSSKEDPKETVALAFVRENPGAQNGLQNAQQQGKKKRKKKRLGLKAGEWGAMLVITGRTWREGGLG

SEQ ID NO: 778843 - protein, 189 aa, Homo sapiens
MAKVPELEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSK

SEQ ID NO: 778844 - protein, 154 aa, Homo sapiens
LPAGPFCLLHPLSCHSLHFVLRQHQSACCICLLHHVLACLCVLLMLICPFSSSCFLIWITLTYSVESDHMASSPDFPWVPSAGNLLSRSQPPHSWHKGQPLTVLLPHCKSITDLHQCNEIIHAHTHVLLDTVSFVRARTHSSLYPVLFRVNGTL

SEQ ID NO: 778845 - protein, 108 aa, Homo sapiens
LLELTCKCMGGLLIKEVARKNQKTYRIYVDKCLSQERQIRIAEGELRMKPPFIQHSECSRQCNLIPSSFMTPDRYCYSLFILEKADSEKLKYLPQGTKVVSSNARVQA

SEQ ID NO: 778846 - protein, 75 aa, Homo sapiens
SGTGRRDGECGRRSPLADRSSCSGDPQVGKLGQNAERSRLLRAVRCQGSTAERRGLREGRGRRAKSVRSGLLKES

SEQ ID NO: 778847 - protein, 75 aa, Homo sapiens; identical to SEQ ID NO: 778846

SEQ ID NO: 778848 - protein, 75 aa, Homo sapiens; identical to SEQ ID NO: 778846

SEQ ID NO: 778849 - protein, 131 aa, Homo sapiens
PKCWDYRCEPPRPAYANNFYSLDIMDKFHEKHKPSKFPREQIENLNNFTLRTWSFPLGSPLSLTRERADFLSLSFSLLPVKPPLLNSSCVSVSKIFLARDDEPQVFTPDNVAASYWGPRPRYQGTAFIKTQ

SEQ ID NO: 778850 - protein, 228 aa, Homo sapiens
MEYEDQEREEGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQR

SEQ ID NO: 778851 - protein, 118 aa, Homo sapiens
AAAYYYYYCSEFKLLTMYGDMALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 778852 - protein, 74 aa, Homo sapiens
LPFTPWLGGASFELGMTMIQFFHYLLIKDGCRVPAVVFTTLRGRQLCAPPDQPWVERIIQRLQRTSAKMKRRSS

SEQ ID NO: 778853 - protein, 144 aa, Homo sapiens
HSQPHITHTLHFTPASQSPCSLTQILHTPRQLALTHSPLACLCSPSMALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 778854 - protein, 150 aa, Homo sapiens
HSQPHITHTLHFTPASQSPCSLTQILHTPRQLALTHSPLACLCSPSMALLLALSLLVLWTSPAPTLSGTNDAEDCCLSVTQKPIPGYIVRNFHYLLIKDGCRVPAVVFTTLRGRQLCAPPDQPWVERIIQRLQRTSAKASLALPGPVSSL

SEQ ID NO: 778855 - protein, 223 aa, Homo sapiens
MEEKQPQKTKEPSKEDEPQQKEMPTHLSLGAESKAEAKTPVLVETQTVDNANEKSEKPPENQKKLSDKDTVATKIKAWWRGTLVRRALLHAALSACIIQCWWRLILSKILKKRRQAALEAFSRKEWAAVTLQSQARMWRIRRRYCQVLNAVRNHPGLLEVPLLCFPGGSSRASTEYTSQASCISRLEILLDSGPCIVTEVYSLLNKGMKLVLFQKIKIKLFQG

SEQ ID NO: 778856 - protein, 36 aa, Homo sapiens
SHQGDGQGKYRYPHWMDGETEAQRKDVTCPRSWHER

SEQ ID NO: 778857 - protein, 131 aa, Homo sapiens
MCSRTWLPFLHHLSTHVYIGKIRDRSSHASKKGLTRVGFVVPPRSLDFILLGDGPKEGCEQRGIHKDGSSSTHFNHQCCTAIGDYTCSFVACERFDACTSEICFSDSSLSSSIAHMRRVSGQPIRQRGHLP

SEQ ID NO: 778858 - protein, 81 aa, Homo sapiens
GGLTIMLENKEEQVTSYVDGGRQRERMRAKQNGLPLIKPSDLMRLIHYHKNSAGKTRPHNSITSHWVPPMTCGNCGSYNSR

SEQ ID NO: 778859 - protein, 183 aa, Homo sapiens
SVAPGGAGACSSAATEPLGLARPLLALPDACDACWGQAAAVPSADRRAAPASRALHQLLPDKPNFCAGFGLAEPERRTARSPGGGQGGSASPRCPRDCGSGASAWAVAGWPPGSALQLRLGMPSVCEEQQVTVVGLAHPCVWAFTHIVKLCKQGCTGSSWYVSYERSYRCSGNLFQWKKMLRW

SEQ ID NO: 778860 - protein, 104 aa, Homo sapiens
TASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTP

SEQ ID NO: 778861 - protein, 122 aa, Homo sapiens
EEEFFLQHSSWVSSLVWVQCLIQLAVARVQNYLLQNCGNVVIKTSNFLRVLLKQSGWCGRDNIVCTSLSQREIYKVKANQISEAGTSPQMFASKQVVDLRDPLLSLSDCLLLWSVDQCSTSI

SEQ ID NO: 778862 - protein, 181 aa, Homo sapiens
TPVIPALWEAEAGRSRGQEIETILANKKQSAMPWDQDPEQSTGNYSEDEQNGKQKWREEGEAGRKREREKEEKNEKELQDEQENKRKRENEKQKQYPEKRLVSKSLMHTLWAKFKLNRCPTIQESLSLSFEFDMTHKQISQWFCKTRKKYNKEMSKRKHKKKHMRWRSLCCQGWSRTPALK

SEQ ID NO: 778863 - protein, 96 aa, Homo sapiens
PNPGIEFEFWLPRERYSPFQARVQALGWPLRQPQPRGVEPQPPAAPAVTPAQTPTLAPGEVGTARVGDEWGLRPVPLTAPPIPQTPAHPALTPAAA

SEQ ID NO: 778864 - protein, 242 aa, Homo sapiens
LPSAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGR

SEQ ID NO: 778865 - protein, 167 aa, Homo sapiens
QAPERSRAVLRGGAGPCSVGLKAARGSPRLWALERKPRKEAAQVTSPGSALSQGSSERPGALSRGLVPFEQSPALQGSGPPPPLLGPGLGSFPQTHPGDFCAPGAEPLLRAAGWAQARFLNVSEPLPPAKSTFQAPGALRETTPRQGVWRAAEEPGAWRSEKTCIFS

SEQ ID NO: 778866 - protein, 124 aa, Homo sapiens
SRGLVPLITICLVWRSHMCLSEMLGGQGQARSSLFHHLLLYRDLGAFDQHQISIISLSTIFPLWCYLQPFLSLRFFFFFLCLFFLFEMESCSVAQAGVQWRDLGSLQPPPSGFKQFSCLSLPSS

SEQ ID NO: 778867 - protein, 87 aa, Homo sapiens
MLLLYLGIEVIRLFFGTKGNLCQRKMPLSISVALTFPSAMMASYYLLLQTYVLRLEAIMNGILLFFCGSELLLEVLTLAAFSSMDTI

SEQ ID NO: 778868 - protein, 159 aa, Homo sapiens
AAGTVRNSRIGTEDGAARGDSGGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSSMDTI

SEQ ID NO: 778869 - protein, 110 aa, Homo sapiens
MLLLYLGIEVIRLFFGTKGNLCQRKMPLSISVALTFPSAMMASYYLLLQTYVLRLEAIMNGILLFFCGSELLLEVLTLAAFSRYCCWGPFLITRGLGSHPREGFTYSSEA

SEQ ID NO: 778870 - protein, 94 aa, Homo sapiens
CLPVFLTTCTIGLWKEVPIDNDVEHTLIAVVCVPRCRIYQIGGTRSRRYDSPGSCLCPLSSVSLDHQFAFSDASNSQNAVEASTVSCYHIQQLT

SEQ ID NO: 778871 - protein, 102 aa, Homo sapiens
MLLLYLGIEVIRLFFGKADHLEMTPWAVSDSTKGNLCQRKMPLSISVALTFPSAMMASYYLLLQTYVLRLEAIMNGILLFFCGSELLLEVLTLAAFSSMDTI

SEQ ID NO: 778872 - protein, 87 aa, Homo sapiens; identical to SEQ ID NO: 778867

SEQ ID NO: 778873 - protein, 136 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 778874 - protein, 136 aa, Homo sapiens; identical to SEQ ID NO: 778873

SEQ ID NO: 778875 - protein, 136 aa, Homo sapiens; identical to SEQ ID NO: 778873

SEQ ID NO: 778876 - protein, 106 aa, Homo sapiens [sequence omitted]

SEQ ID NO: 778877 - protein, 180 aa, Homo sapiens
FGGDGSTCEWSTERGGTASQESGAQPLQEALKVACESSASRGGSVEHRSRSESCLALSTTFQACSFGSFLARWLKTCCPQAEGGPYPWTPSSGRLQWRQLSLQVERCRDCFASTSFNTYFSFQQQSLPLRSRIHPGPEAAPEYHILTPLVCKTSACPQVQRSSHLNKRSLRSRRVIPTTF

SEQ ID NO: 778878 - protein, 32 aa, Homo sapiens
MIEPRSQIEPRSQIGPRSQIEPRSQIDRRSHV

SEQ ID NO: 778879 - protein, 104 aa, Homo sapiens
GVYDGARARGGPRVFSRRLLGVLSCPQVWLATSGRLCLPRGLRGAAGLLYDYPWGWRSIVGVGGWVVGWLSGGCIRRAARAGCLCGCGSLIGSLLSGVVVAVSV

SEQ ID NO: 778880 - protein, 104 aa, Homo sapiens; identical to SEQ ID NO: 778879

SEQ ID NO: 778881 - protein, 104 aa, Homo sapiens; identical to SEQ ID NO: 778879

SEQ ID NO: 778882 - protein, 104 aa, Homo sapiens; identical to SEQ ID NO: 778879

SEQ ID NO: 778883 - protein, 104 aa, Homo sapiens; identical to SEQ ID NO: 778879

SEQ ID NO: 778884 - protein, 104 aa, Homo sapiens; identical to SEQ ID NO: 778879

SEQ ID NO: 778885 - protein, 104 aa, Homo sapiens; identical to SEQ ID NO: 778879

SEQ ID NO: 778886 - protein, 104 aa, Homo sapiens; identical to SEQ ID NO: 778879

SEQ ID NO: 778887 - protein, 104 aa, Homo sapiens; identical to SEQ ID NO: 778879

SEQ ID NO: 778888 - protein, 104 aa, Homo sapiens; identical to SEQ ID NO: 778879

SEQ ID NO: 778889 - protein, 104 aa, Homo sapiens; identical to SEQ ID NO: 778879

SEQ ID NO: 778890 - protein, 104 aa, Homo sapiens; identical to SEQ ID NO: 778879

SEQ ID NO: 778891 - protein, 104 aa, Homo sapiens; identical to SEQ ID NO: 778879

SEQ ID NO: 778892 - protein, 104 aa, Homo sapiens; identical to SEQ ID NO: 778879

SEQ ID NO: 778893 - protein, 104 aa, Homo sapiens; identical to SEQ ID NO: 778879

SEQ ID NO: 778894 - protein, 104 aa, Homo sapiens; identical to SEQ ID NO: 778879

SEQ ID NO: 778895 - protein, 104 aa, Homo sapiens; identical to SEQ ID NO: 778879

SEQ ID NO: 778896 - protein, 104 aa, Homo sapiens; identical to SEQ ID NO: 778879

SEQ ID NO: 778897 - protein, 104 aa, Homo sapiens; identical to SEQ ID NO: 778879

SEQ ID NO: 778898 - protein, 104 aa, Homo sapiens; identical to SEQ ID NO: 778879

SEQ ID NO: 778899 - protein, 104 aa, Homo sapiens; identical to SEQ ID NO: 778879

SEQ ID NO: 778900 - protein, 104 aa, Homo sapiens; identical to SEQ ID NO: 778879

SEQ ID NO: 778901 - protein, 104 aa, Homo sapiens; identical to SEQ ID NO: 778879

SEQ ID NO: 778902 - protein, 104 aa, Homo sapiens; identical to SEQ ID NO: 778879

SEQ ID NO: 778903 - protein, 104 aa, Homo sapiens; identical to SEQ ID NO: 778879

SEQ ID NO: 778904 - protein, 104 aa, Homo sapiens; identical to SEQ ID NO: 778879

SEQ ID NO: 778905 - protein, 104 aa, Homo sapiens; identical to SEQ ID NO: 778879

SEQ ID NO: 778906 - protein, 104 aa, Homo sapiens; identical to SEQ ID NO: 778879

SEQ ID NO: 778907 - protein, 104 aa, Homo sapiens; identical to SEQ ID NO: 778879

SEQ ID NO: 778908 - protein, 104 aa, Homo sapiens; identical to SEQ ID NO: 778879

SEQ ID NO: 778909 - protein, 104 aa, Homo sapiens; identical to SEQ ID NO: 778879

SEQ ID NO: 778910 - protein, 104 aa, Homo sapiens; identical to SEQ ID NO: 778879

SEQ ID NO: 778911 - protein, 104 aa, Homo sapiens; identical to SEQ ID NO: 778879

SEQ ID NO: 778912 - protein, 94 aa, Homo sapiens
MRSKTIRARAASKKVYFAEKVTSLGKDGHGPCLAESAGEDTDPGGHAEHEAAYAKPCMNLFGPRSDPCGGSNYDGTEEGKPRYAQKGAPGQTWA

SEQ ID NO: 778913 - protein, 104 aa, Homo sapiens; identical to SEQ ID NO: 778879

SEQ ID NO: 778914 - protein, 104 aa, Homo sapiens; identical to SEQ ID NO: 778879

SEQ ID NO: 778915 - protein, 104 aa, Homo sapiens; identical to SEQ ID NO: 778879

SEQ ID NO: 778916 - protein, 104 aa, Homo sapiens; identical to SEQ ID NO: 778879

SEQ ID NO: 778917 - protein, 104 aa, Homo sapiens; identical to SEQ ID NO: 778879

SEQ ID NO: 778918 - protein, 104 aa, Homo sapiens; identical to SEQ ID NO: 778879

SEQ ID NO: 778919 - protein, 104 aa, Homo sapiens; identical to SEQ ID NO: 778879

SEQ ID NO: 778920 - protein, 104 aa, Homo sapiens; identical to SEQ ID NO: 778879

SEQ ID NO: 778921 - protein, 104 aa, Homo sapiens; identical to SEQ ID NO: 778879

SEQ ID NO: 778922 - protein, 104 aa, Homo sapiens; identical to SEQ ID NO: 778879

SEQ ID NO: 778923 - protein, 104 aa, Homo sapiens; identical to SEQ ID NO: 778879

SEQ ID NO: 778924 - protein, 104 aa, Homo sapiens; identical to SEQ ID NO: 778879

SEQ ID NO: 778925 - protein, 104 aa, Homo sapiens; identical to SEQ ID NO: 778879

SEQ ID NO: 778926 - protein, 104 aa, Homo sapiens; identical to SEQ ID NO: 778879

SEQ ID NO: 778927 - protein, 104 aa, Homo sapiens; identical to SEQ ID NO: 778879

SEQ ID NO: 778928 - protein, 104 aa, Homo sapiens; identical to SEQ ID NO: 778879

SEQ ID NO: 778929 - protein, 104 aa, Homo sapiens; identical to SEQ ID NO: 778879

SEQ ID NO: 778930 - protein, 104 aa, Homo sapiens; identical to SEQ ID NO: 778879

SEQ ID NO: 778931 - protein, 104 aa, Homo sapiens; identical to SEQ ID NO: 778879

SEQ ID NO: 778932 - protein, 209 aa, Homo sapiens
KFLQSYNSGEAPQLHCHFVRCCRPSSGKETMTDKTEKVAVDPETVFETSQECDSPSYQKRQRMALLARKQGAGDSLIAGSAMSKEKKLMTGHAIPPSQLDSQIDDFTGFSKDGMMQKPGSNAPVGGNVTSNFSGDDLECRGIASSPKSQQEINADIKCQVVKEIRCLGRKYEKIFEMLEGVQGPTAVRKTIFLNPSSREAARCIETRLC

SEQ ID NO: 778933 - protein, 272 aa, Homo sapiens
IVGGSAAPPGAWPWLVRLQLGGQPLCGGVLVAASWVLTAAHCFVGAPNELLWTVTLAEGSRGEQAEEVPVNRILPHPKFDPRTFHNDLALVQLWTPVSPGGSARPVCLPQEPQEPPAGTACAIAGWGALFEDGPEAEAVREARVPLLSTDTCRRALGPGLRPSTMLCAGYLAGGVDSCQGDSGGPLTCSEPGPRPREVLFGVTSWGDGCGEPGKPGVYTRVAVFKDWLQEQMSASSSREPSCRELLAWDPPQELQADAARLCAFYARLCPGS

SEQ ID NO: 778934 - protein, 108 aa, Homo sapiens
MYIDDCLRATLEVMEAPAESLSMRTYNVSAMSFTPEELAQEVLKHVPEFQITYNVDAVRQAIADGWPMNFDDSNARKDWGWKHDFDLPELVTAMLNFHGSESRVAQAN

SEQ ID NO: 778935 - protein, 673 aa, Homo sapiens
GKVFPAGRMEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDTHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYWHLTPITPWAIVPV

SEQ ID NO: 778936 - protein, 1026 aa, Homo sapiens
GKVFPAGRMEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDTHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLRDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 778937 - protein, 366 aa, Homo sapiens
MTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLRDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 778938 - protein, 903 aa, Homo sapiens
GKVFPAGRMEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDTHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKATDNPTASSLFAQRLKTLRDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 778939 - protein, 140 aa, Homo sapiens
APRVRLGVRQRLPGEGVSPARLGCGLSGCTLTPRSAQVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 778940 - protein, 1026 aa, Homo sapiens; identical to SEQ ID NO: 778936

SEQ ID NO: 778941 - protein, 1026 aa, Homo sapiens; identical to SEQ ID NO: 778936

SEQ ID NO: 778942 - protein, 725 aa, Homo sapiens
GKVFPAGRMEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDTHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLL

SEQ ID NO: 778943 - protein, 317 aa, Homo sapiens
AEEGGPGAPRLLAVSASGYITELSVRCHRPRGPAQQMHRDARAQKASRGFPPRVPKSFPFNTSVVYKKTLFVEFTDHLFNIAKPRPPWMGLLGPTIQAEVYDTVVITLKNMASHPVSLHAVGVSYWKASDGTLNMMIRPVKRENRRWYKSSLVEAIPHVWQVLQRDMVHLASDPLMPLPTHIFLMWTWLQDLNLRTHWSPTSMYEQGVWRRQTDTDLAHHLYYLLAVIDERETFGTQKTTELLDAAIGMLHLLGAWPYIAHSTMGHVTQVLCQVLSTPAQHSPGSPQLRTRVLHSVHNSSASNRLATQSCNPGHGAS

SEQ ID NO: 778944 - protein, 60 aa, Homo sapiens
MCPGPGNQQDCRWRPIVGGPQMEAMVIAIVCPMHSHSRMYTEMSCGRLGTVAHACNSSTL

SEQ ID NO: 778945 - protein, 522 aa, Homo sapiens
MNAGWFTCLVHGCPQVLAHSRCSISACRLTECCPLQHGLGPCCWPPRGAGQPPLCAHLPGGPSSPCPSKAGPQDIPLFKAQNPGLHHYMGLGRKRMVFSLKHDSGTAVAQIMSSQNPRPLEPPNITSSQNAQPLEPQNKTFFGPRVIADGIKLKMRPSWIRITGILVTQQENTETDKEMATETEAEAEAEIGPMQPQLRNACSPQKLEETEKHPPLEPSEGARPCGALTSDHGNALLWLKAAQFVARCDGRPRKPIQVQKARCLGLPSSRRLRPPEFTSPACSGALGHLRGTMKGWGLVPRLLVLAEKTRAHPSTSQPQLPHLRNRHNSPHLSRLQQKLLEKMGERTWPTDPKWMHGELALTQPWPSPCCSPSSSPPHLPPTPHLPLTLPPNLFIPFPPGSRKVRLAQHRHTPEGVLCQLEKKEEWEERAGAPGAPGVDSNLPTEAQPCCSPAWRSPLLPKPTEATEVPRWKSEGHVALPCSSHPHPESRPRQVKGEHTARHPIISQDPVCSCSATGLCFSI

SEQ ID NO: 778946 - protein, 133 aa, Homo sapiens
SGPLGTHRSLIENNRNNNSSTAYYNFTGSLFYPPTSLRVLRVSLHHFRRCVGPTFFVATGFHGLHVIIGPTRCVGPTLGQPTVGEPRRHLGGPCLCQALPPCLLSTLLASQGNVGQRPSSHTKNGPTETSLVP

SEQ ID NO: 778947 - protein, 104 aa, Homo sapiens
SNGFPFKWRGGCRRDTMKRILETPGSNTDESAFFQNRAPHSGPHLSLGAQCSERAWLSGEKRQEHERATKSWSGRCGSSVWGTARESLLVTPAQPPAAGLAAGS

SEQ ID NO: 778948 - protein, 77 aa, Homo sapiens
AGAVDGKLYVCGGFHGADRHEVISKEILELDPWENQWNVVAINVLMHDSYDVCLVARMNPRDLIPPPSDLVEEGNEH

SEQ ID NO: 778949 - protein, 223 aa, Homo sapiens
MISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYN

SEQ ID NO: 778950 - protein, 50 aa, Homo sapiens
ASALSITLIATSLTSAYSTRIILLTLTGQPRFPALTNINENNPTLLNPIK

SEQ ID NO: 778951 - protein, 135 aa, Homo sapiens
NRFPLPLLTVSSMRAGGLSILLTTVSMAYSTCSVSVWYTHVCKAGKLVEHLSLQTPCPPLYLDKPKPPHICRELSLGGRVLGAGSAQSGGSGQSAPIQKMRAWGSMVPVALLVLTNRLQPQTRSQWVDPKPHVLG

SEQ ID NO: 778952 - protein, 67 aa, Homo sapiens
SASASQNTGVIGMNHYARPRSSDFGYGPPRNSSSSMWVWGHEGLFSGGSKSPLPQHGKSQKLEFQVR

SEQ ID NO: 778953 - protein, 109 aa, Homo sapiens
RQDTSVQVLGRAPLPPPAASSASCRPPSSCQQSSVLPPRQPSPPPWGSLQKEAGREGRKAQVEEDEEGTPAASSSPAPQGGKGKEEQTLGSTLTSERVPVKKEGGEPSF

SEQ ID NO: 778954 - protein, 116 aa, Homo sapiens
PGSHASAYSAVLAQWQPAHVCTHTHPGMFSPCPFSCHSQGHVNTRWCPHLYPNHGPLHSHLNRQTHTRIYSPTAIQPSTESCPRAPISPTDAYTHSSHDVIMSSHTPSPGTYSLTH

SEQ ID NO: 778955 - protein, 125 aa, Homo sapiens
KTESCSVAQAGVQWPDLGSLQAPPPGFTPFSCLSWLFFQAPFLCPSLLLDSSNLQGLGAQSQASLLLQIPSIRQAQWLMPGIPALWEVKVGRSPEVRSSRSASPTWGNPNSTKHKKLAGHGGACL

SEQ ID NO: 778956 - protein, 136 aa, Homo sapiens
MVTLITEKLQSQSLDDLTCKAEAGPLQYSAETLNKSGRLFPLELNDQKSLEESPVEDRQSESQADTGPMNSSLPDGPVLLAGHNHGVYHGGSHSARAKGDKAWVQQAPWTPVESTGSSKGPQRTKRDGRVLVKNPR

SEQ ID NO: 778957 - protein, 113 aa, Homo sapiens
MSTHNESFSLGTRSTEFPSDSWETYDLKKLRNLCSSSRPSNYRVGFRGPGRNPGLPQRTWCVCGSAKLVPSSSPKDATGPGISGDHDSHAPHDFSLQNFLSSTCISPAKLRPG

SEQ ID NO: 778958 - protein, 60 aa, Homo sapiens
QLLSLEWSGGGRGRCCIHRVQTEPGMKGEARPWPSLYRGYHDARHAGREVKVAQSTCRTL

SEQ ID NO: 778959 - protein, 175 aa, Homo sapiens
RKGGAYAGKMEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 778960 - protein, 158 aa, Homo sapiens
RKGGAYAGKMEATTAGVGRLEEEALRRKERLKALREKTGRKDKEDGEPKTKHLREEEEEGEKHRELRLRNYVPEDEDLKKRRVPQAKPVAVEEKVKEQLEKHKMYEVAAGPAGKCAAVDVEPPSKQKEKAASLKRDMPKVLHDSSKDSITVFVSNLPY

SEQ ID NO: 778961 - protein, 132 aa, Homo sapiens
VVAHARGWARQWSATRSPSDSCFPGVARDKEDGEPKTKHLREEEEEGEKHRELRLRNYVPEDEDLKKRRVPQAKPVAGKQAVPLHLCFLALSATLHLSRLCSLRITSSTRTGVGPAGRTLCYHLMADAHSRP

SEQ ID NO: 778962 - protein, 175 aa, Homo sapiens; identical to SEQ ID NO: 778959

SEQ ID NO: 778963 - protein, 175 aa, Homo sapiens; identical to SEQ ID NO: 778959

SEQ ID NO: 778964 - protein, 72 aa, Homo sapiens
PGFQRSLPATGLHDHCPMIDGLETVLFSLALMGLTGVNIPPGDVFSHLVLRLRDTGPVQRGCLPCPASSEAE

SEQ ID NO: 778965 - protein, 76 aa, Homo sapiens
SKVSEWTTTAPSDLPGYSTQIRIPSPQDLSSHSHPHHADGNSILLSAAAKHTLLSHPTPGPPGKSSGAHPQGTSRF

SEQ ID NO: 778966 - protein, 159 aa, Homo sapiens [sequence omitted]

SEQ ID NO: 778967 - protein, 50 aa, Homo sapiens
LRSTPASHWFEQQAPCTNSIMSIPARAAHSPAAFSSHSPTPWCWRVFPGT

SEQ ID NO: 778968 - protein, 351 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKVIPLTVSLAQWGDNIPYGSCVSY

SEQ ID NO: 778969 - protein, 482 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKEKNKALASDFPHISACAHEFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 778970 - protein, 477 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKDFWLPSAGKRERNQFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 778971 - protein, 477 aa, Homo sapiens; identical to SEQ ID NO: 778970

SEQ ID NO: 778972 - protein, 351 aa, Homo sapiens; identical to SEQ ID NO: 778968

SEQ ID NO: 778973 - protein, 351 aa, Homo sapiens; identical to SEQ ID NO: 778968

SEQ ID NO: 778974 - protein, 365 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKDFWLPSAGKRERNQF

SEQ ID NO: 778975 - protein, 351 aa, Homo sapiens; identical to SEQ ID NO: 778968

SEQ ID NO: 778976 - protein, 351 aa, Homo sapiens; identical to SEQ ID NO: 778968

SEQ ID NO: 778977 - protein, 119 aa, Homo sapiens
FGSEVPAPSSPVLGYMRGVETTQVLSGLTTRTNSSFKHSSGFFLSEGHVVGIFFLNSEILRQQFFTKRSSSALFVTLLLLSQHLLQLHLQNCCFFAVVFVLEKPVTASAYLLCRAFNII

SEQ ID NO: 778978 - protein, 126 aa, Homo sapiens
YPPLYTQYIHHSTMYTPLSMYTPLYNEHTTLHTMYTPLSMYIPLYNEHTTLHTMYTPLCKQCTHHSTMNTPLYTQCTHHSTMNTPLYTPCTCHSTIYPPLYTQCIHHSTMNTPLYTPLYNVHTMLQ

SEQ ID NO: 778979 - protein, 102 aa, Homo sapiens
MMVIYTGGHIILTFLILPYTGNNEKMKFLNFKDISNWRPHIQPISWPVGGAKGLSRPLGEGFPFGPAGKQFSYPFSTHRWLCAMCCVLRRERQSLISIHTRD

SEQ ID NO: 778980 - protein, 227 aa, Homo sapiens
MVVRKRKRLQGREASVWSGQVPGSGPPAAMPSPRRSMEGRPLGVSASSSSSSPGSPAHGGGGGGSRFEFQSLLSSRATAVDPTCARLRASESPVHRRGSFPLAAAGPSQSPAPPLPEEDRMDLNPSFLGIALRSLLAIDLWLSKKLGVCAGESSSWGSVRPLMKLLEISGHGIPWLLGTLYCLCRSDSWAGREVLMNLLFALLLDLLLVALIKGLVRRRRPAHNQMD

SEQ ID NO: 778981 - protein, 117 aa, Homo sapiens
DAWVDGRVGCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 778982 - protein, 90 aa, Homo sapiens
THFREGAEEVGWWRRGRDGGAFEDSERLGASPQVNPGPEQSQRRRVVDVALRQGEPCLVQHINRGYFVNCRGIWREQGPEKEVQTRMVIL

SEQ ID NO: 778983 - protein, 95 aa, Homo sapiens
PLMQGQLAVLRIKSDWAQALRKDEGEAWLSCHPPGKPSLYGSLTCQGIGLDGIPEVTASEGFTVNEINKKSIHISCPKENASSKFLAPWRSCGPR

SEQ ID NO: 778984 - protein, 375 aa, Homo sapiens
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 778985 - protein, 375 aa, Homo sapiens; identical to SEQ ID NO: 778984

SEQ ID NO: 778986 - protein, 238 aa, Homo sapiens
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSKLIMICSIVLFS

SEQ ID NO: 778987 - protein, 409 aa, Homo sapiens
LTSGKGRKRWAGGGGVEMAAPLRIQSDWAQALRKDEGEAWLSCHPPGKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 778988 - protein, 116 aa, Homo sapiens
TCSEHVCEGMESFMQLHLLCPCSSFTPSSILGSFFLLLGILDTAIVDRGRNVVSASRDGTARLWDCGRSACLGVLADCGSSINGVAVGAADNSINLGSPEQMPSKLIMICSIVLFS

SEQ ID NO: 778989 - protein, 375 aa, Homo sapiens; identical to SEQ ID NO: 778984

SEQ ID NO: 778990 - protein, 374 aa, Homo sapiens
MKGRLAELSSPRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 778991 - protein, 240 aa, Homo sapiens
MQLHLLCPCSSFTPSSILGSFFLLLGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 778992 - protein, 168 aa, Homo sapiens
ALGNACCSCPCPRAPSPSPSPVAHHPCFGAMQLPPFDMWKDYFNLSQVVWALIASRGQRLETQEIEEPSPGPPLGQDQGLGAPGANGGLGTLCNFCKHNGESRHVYSSHQLKTPDGVVVCPILRHYVCPVCGATGDQAHTLKYCPLNGGQQSLYRRSGRNSAGRRVKR

SEQ ID NO: 778993 - protein, 101 aa, Homo sapiens
QNVAFGKDDVEGEELLPLNAAAVYAKTWGDGPGTVAHACNPSTVGGRGGQIMGSGVRDQPDQHGETPSLLKKKNTKISWVWWRVPVIPATQGAKARESLEP

SEQ ID NO: 778994 - protein, 107 aa, Homo sapiens
QQGLTLLLRLECGGTITAHCSLNLPGSSNPPTSASYVARITGMRHHVQLIFKFLVLGLAVLPRLVLNYSWAQVILPPQPSKVLELQTLGTTRMICILVMVVVVWVYT

SEQ ID NO: 778995 - protein, 108 aa, Homo sapiens
MREWAHMYLQSSVEAPLSYSPPLSQWPLLGSLSPKPQLTGKATESMQMPSLLSQPTPDNPVYGLSRLLASLGPPCLRAVSALSSILFKRVSSDGKKRESTQGIHGAPF

SEQ ID NO: 778996 - protein, 279 aa, Homo sapiens
MLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALGVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFLCFLTIARDQKIILNSKL

SEQ ID NO: 778997 - protein, 110 aa, Homo sapiens
MTYRLPHSCGSVPISRPQVLVASTTVLELSEAFTLNCSHENGTKPSYTWLKDGKPLLNDSRMLLSPDQKVLTITRVLMEDDDLYSCMVENPISQGRSLPVGLVGRLSASR

SEQ ID NO: 778998 - protein, 102 aa, Homo sapiens
LHPPFKHPSTYRSSDISPAISHLPSLPHLISPIHLLSHFPIHPLSSPLPRPTPAYRTHSFLHSPIHAHLFIHFLHHPLIHSGGRCQEIGVCVCVRACVHLHT

SEQ ID NO: 778999 - protein, 110 aa, Homo sapiens
SAMSRCQICYLKHHPASAPRFPNVSQRSHLQNLFLKTHLTRESNREKVAFEPGRMNKSSLQKSSLQEQNDAVRKPPWETTLNWLTKLLRAEHCLGLLYSHLYKEKEAVMD

SEQ ID NO: 779000 - protein, 48 aa, Homo sapiens
MWGEILEMTLAPGDGILKQISARRDPVAMGHTFTGPELSVGFIYWDTG

SEQ ID NO: 779001 - protein, 120 aa, Homo sapiens
QAGLREASPAPAAMLRPEAVLDLASFLLQDGRLCLLHGCMTSLGWVCPGKVGVHWEPCHVSGPVLALPRVRDLGPPHWLGGAGWVEIHMCSLRPRVPGCPQQGLHPSLCAYSCAYEFGFV

SEQ ID NO: 779002 - protein, 89 aa, Homo sapiens
ESPSSPQQEAFVPAIRGAAFARGVRCFLESSLTGHIAEVRAGAGSRPPCAASLAPGNLQWLRPLGVRRLCRANLDLVLQFLLTIPNSTL

SEQ ID NO: 779003 - protein, 89 aa, Homo sapiens; identical to SEQ ID NO: 779002

SEQ ID NO: 779004 - protein, 130 aa, Homo sapiens
DIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYL

SEQ ID NO: 779005 - protein, 111 aa, Homo sapiens
DIGDTTIQLSWSRGFDNHSPIAKYTLQARTPPAGKWKQVRTNPANIEGNAETAQVLGLTPWMDYEFRVIASNILGTGEPSGPSSKIRTREAGESPVCPKKLSSGQRPWHHL

SEQ ID NO: 779006 - protein, 297 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 779007 - protein, 297 aa, Homo sapiens; identical to SEQ ID NO: 779006

SEQ ID NO: 779008 - protein, 262 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMFAGRSKKETKYSLKAVEDMLETLQITQS

SEQ ID NO: 779009 - protein, 262 aa, Homo sapiens; identical to SEQ ID NO: 779008

SEQ ID NO: 779010 - protein, 205 aa, Homo sapiens
CSRGQTVTWELSPALQVAFSSFSSSHALRAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 779011 - protein, 204 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDLQVEVRRKPNILLRLSKTCWKHCRSPSLKVSKTL

SEQ ID NO: 779012 - protein, 132 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTGETPSLLKSKN

SEQ ID NO: 779013 - protein, 128 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTDSRPVMG

SEQ ID NO: 779014 - protein, 315 aa, Homo sapiens
HVTASPRPLTPLPLGSGKMAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 779015 - protein, 273 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQPATR

SEQ ID NO: 779016 - protein, 201 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYALNTQHFVELSIPKVDLKTSNFQESILHRH

SEQ ID NO: 779017 - protein, 201 aa, Homo sapiens; identical to SEQ ID NO: 779016

SEQ ID NO: 779018 - protein, 212 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHEIESDSHAHFLVHEYLTLFSYYKQLMRNRMKTFVYCLWSIYIM

SEQ ID NO: 779019 - protein, 123 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMESFGSRNGKTSKKITIADCGQLE

SEQ ID NO: 779020 - protein, 90 aa, Homo sapiens
SGARAVFRPGLVRGRLAASAYGVCWLRRLAHSLEGSARPCSLDIIFHTTPVRRLEELSRGWRDARGYCVDGGCASDTGSERKISYTANFR

SEQ ID NO: 779021 - protein, 80 aa, Homo sapiens
RQISLNASKQIMHLGPLGFLHCRASFGRYGFALGFPKDGMATENPLMRCLQKLELGLSGWVLGVLKQSESSEWVLEGDGF

SEQ ID NO: 779022 - protein, 112 aa, Homo sapiens
QGGHSFKQFILQARKTIGKISFLLSLAFLFNPIIFPTVWAEVQKLQTGTFCPFLFFSLPKVTLAIDGLGKNYHAPFPQSYFLSSILSYSLFFFALLLGSKDQEGRKSHLNGA

SEQ ID NO: 779023 - protein, 117 aa, Homo sapiens
QPTRLNATNTNTRVNHLGLRGCFCHCHCHHSHQAGCPRGSRTSPPTPPTVVTAGIQVICLETQQLAHLDSLTMVPDHPGAQRHTYSSHCCHHWGSKTDLPGVTVPSKTTASFNNCTL

SEQ ID NO: 779024 - protein, 185 aa, Homo sapiens
RREAGPRRGAMLRTEVPRLPRSTTAIVWSCHLMATASAMAGPSSETTSEEQLITQEPKEANSTTSQKQSKQRKRGRHGPRRCHSNCRGDSFATYFRRVLKQVHQGLSLSREAVSVMDSLVHDILDRIATEAGRLARSTKRQTITAWETRMAVRLLLPGQMGKLAESEGTKAVLRTSLYAIQQQRK

SEQ ID NO: 779025 - protein, 69 aa, Homo sapiens
LSVHRRISSQIQNLQFFQNEMSRDHKYHTTGINSHTGLLRTHLKTARRSAREQHRLYVYVMFQFLQLHK

SEQ ID NO: 779026 - protein, 69 aa, Homo sapiens
RQIESSRYQFHSSVEQPKRHRTHVKTACLYCKCSFQTAAPTLSYSAMLLPLSSLGAATATPVGQWGKLA

SEQ ID NO: 779027 - protein, 82 aa, Homo sapiens
LRHTITQSKALTLFNSMKAERGEEAAEEKCEASRGWLMRFKGRSHLHNVQIQGEAASAAGEAGASSPEDLAQIIDEGGRTKQ

SEQ ID NO: 779028 - protein, 126 aa, Homo sapiens
TLTSLSRPPGFPPPLLLPVLSFCRLRLLAYLWGLVLFLVFMETAWPQEAQAALSCKGRIMQATAALPLSHRALFLTRFIRDMVWQSLDPTVGLASGDRTNIPTPQRRTSGECKEPLSRGRQPAGCS

SEQ ID NO: 779029 - protein, 60 aa, Homo sapiens
ARSLFGATVHDGRIIVAAGVTDTGLTSSAEVYSITDNKWAPFEAFPQERSSLSLVSLVGT

SEQ ID NO: 779030 - protein, 244 aa, Homo sapiens
SCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDK

SEQ ID NO: 779031 - protein, 127 aa, Homo sapiens
PVLTVGRRRSMDKHSPCESVNLPALAVGRRRRPHKHSPCESVNLPVLTVGRRRSLDKHSPCESVNLPALAVGHRRSLDKHSPCESVNLPALAVGHRRSVDKHSPCESVNLPAFAVGRRRRPHKHSPC

SEQ ID NO: 779032 - protein, 102 aa, Homo sapiens
MLRHKTKRGHASLDCLKVFDGIPPPYDKKKRMVVPAALKVVRLKPTRKFALLGRQAQEVRWKYQAVTATLEEKRKEKAKIHYWKKKQLMRLRKQAEKNVKKN

SEQ ID NO: 779033 - protein, 107 aa, Homo sapiens
RLQPCTPDPRPQVQLRSHPRTRAGTWPVAQRNHPRPPEPCTGRQASGPGPPGLPAAPRNVMHWGGGGGGGGGGGNRGGAAAAALPQSRHIQKRRKMAPSRDRLLHFG

SEQ ID NO: 779034 - protein, 233 aa, Homo sapiens
GVRLPPHRLAPPLATCPARRAGAVPVRRPVYAGSFSQSFFVLRCEKRWDSSIKATSGKSVCRTDASRLTHRERLLRPAEKRGALTRARSSHSSVGLGGWRAGGGGRACAGSGRSCGTRRADCACALVAWLRRGRGHRAAPEVGRWLPPVPGQRPGVSPTHPLLSLRSAQRPGQGGAARPPRGAGCPPTRKGDARAPRPQAPPCAFAAPGPPRPTLAPALLSSRGGAAYSVRSP

SEQ ID NO: 779035 - protein, 106 aa, Homo sapiens
THSRDTRPFPHPLHRKEKEVRLGPCPQLPQAGKFTSTADRAGDNSSIRKTHKAIGLQRECSPSARSFSRTKPAEKAVSEYHARTTGSLFLGSGIYRLRCWSPTSLI

SEQ ID NO: 779036 - protein, 88 aa, Homo sapiens
TSYPLTDLGASTRILSTFLQNLGNKSETPSQNHNNNNRTTEMDDGSGKPTRQREARTERGTGSSAQCRYRGSLRLTTGHSSREVLVSS

SEQ ID NO: 779037 - protein, 242 aa, Homo sapiens
DADAVTSLIPTIIRNPCGRHRRQTFRSLSNYCRTSVPTGAFRYKSLVYSTDTYVQCPTASREEAAPCAASDPMYDRVVTRLYTCGPSRFNTQAYVKTPRDRLSRWMLNSSRLHETAFLSPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAER

SEQ ID NO: 779038 - protein, 138 aa, Homo sapiens
MLTLTRHRTRNASLDPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAER

SEQ ID NO: 779039 - protein, 194 aa, Homo sapiens
AGVGHREVRHKACISTYGACRMCKSGAHCAVLPMYIVSYTPLAGIKKRIKPSTTVTDCVTLTRIHETAFLSPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAER

SEQ ID NO: 779040 - protein, 184 aa, Homo sapiens
AQAGSAEPAMSAYGMPMYKSGDLVFAKLKGYAHWPARIEHMTQPNRYQVFFFGTHETAFLSPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAER

SEQ ID NO: 779041 - protein, 66 aa, Homo sapiens
MGQHEPLTGVAGNMSPAGNITARGAVGGPPSHRMAMLLVLLRQCGPRTQASCLMAFICPSRNSEGG

SEQ ID NO: 779042 - protein, 86 aa, Homo sapiens
RRRVTPSDRFGFVTLRVPVSVYDDNRSVIYESCIPGIIACVDGSSCWMHLTNMIISGENARVYGDRNHRIGRSWKSSERMSHEDVS

SEQ ID NO: 779043 - protein, 275 aa, Homo sapiens
RSWGKGREGVVSPAGLGGALPGDGKFGSPSRLGCSLGEGVQRVAALGMGKEQELLEAARTGHLPAVEKLLSGKRLSSGFGGGGGGGSGGGGGGSGGGGGGLGSSSHPRLQSAQKSKHAMRADSVFLSICTRPAPRRRTSRVLLSYMPLLDEGQSVNVCRPALATQPLQPCCLLQLAHHGLSDRRFLSERTDGRLTNRGLTSPAPAYASCHLRGPGQGEMPSTSASLLTSTFTVALPPRTKEARSGHMNTGGPNGEPCPVPLVGSCLAMAHPKSVV

SEQ ID NO: 779044 - protein, 104 aa, Homo sapiens
TQSQFQPLLETREGADQIRKPRASAPQGGSWSMDAGAFLPGVWSSGNLHCEGAPSGGDAVSSRARLREPPAQSALDSRRRCVILPVSGQEAQGHDPVSGCGDEG

SEQ ID NO: 779045 - protein, 72 aa, Homo sapiens [sequence omitted]

SEQ ID NO: 779046 - protein, 147 aa, Homo sapiens
GSLQCAGLSALDGSFYLFIIIILRQNVALLPRLECNGAISAHCNLCLLGSSNSLTSASQIAGITGVGHNTRLIFVFLVETGFHHVDQTGLELLTSGDPPASASQSAGITGVSHCARPLVSFIINWQTLSVSLSSMSHSSKLIKPKRG

SEQ ID NO: 779047 - protein, 117 aa, Homo sapiens
PGVMAGEEGWRGRLGRAHRGYYQETPDSCRRGLVRWGLWESTELGATRRFHPHSVVCTFTGAIKTKDESQAGLGACLLRAPAPRPPGRAGSQPGFLLGTLWGGSCTGPPLAPCTQAP

SEQ ID NO: 779048 - protein, 131 aa, Homo sapiens
MDSVEKGAATSVSNPRGRPSRGRPPKLQRNSRGGQGRGVEKPPHLAALILARGGSKGIPLKNIKHLAGVPLIGWVLRAALDSGAFQRCACARVGGAAWAGVGRGSRAAGGAGASGATALGRGPSLMPGMCK

SEQ ID NO: 779049 - protein, 138 aa, Homo sapiens
YGDDVRVRSNSGVVLVPGSGQILFIHLRSSWKWIHMRVMDRVWLTIFPGKRVGSDAEMGVGDELGSLVLSVVRLQVHIQHADPGERDEEGESLPHACTQAWVRMSFSKVLLYRLLHIILHLHLGNNELFPFFEMYLRR

SEQ ID NO: 779050 - protein, 87 aa, Homo sapiens
EDFDMCYWIDRNKKMGWGESQLSFKRKWNFIRKACARDKVSGEPLRMQRTQWSRGDYLGKESMRKNAELETTTGLKLSDEWSVRLDW

SEQ ID NO: 779051 - protein, 214 aa, Homo sapiens
MSLIHKEPSQNQYTKIGRVQWLMPVIIAVWEAKVEGSLESRSSRPCLCNRVIPAVSIKIIKTKLKETLLCSPLPLVHPCRPTRTFRRAAHTWGSHSAGLWLNSAFALVWTFGRAVHVWGSLSAGLWLNSAFALVGTFGKAVHAWGSLGAEGLWLSSTFASVWTFGRAVQKDSGSIVALHRFGPSGGWYTPGVVSVQDSGSIAPLHWFGPSGGQY

SEQ ID NO: 779052 - protein, 68 aa, Homo sapiens
MEGTLRQIKIRRQGVRYMGEINNELPRNKDLFVRVSPRKPPPSFPPPIVSELTEKLMQESVRDQSIIF

SEQ ID NO: 779053 - protein, 88 aa, Homo sapiens
RRHVAVRKYEEMREEASNIRPQYAILTPETWPRWRGDERQGVQHLLRAVNMEPDQYQMGSTKVFVKNPESVSVFEGQAEKERGRERKV

SEQ ID NO: 779054 - protein, 529 aa, Homo sapiens
TVSAPVVPQSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYVGSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKVRH

SEQ ID NO: 779055 - protein, 195 aa, Homo sapiens
TVSAPVVPQSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQVGGQAVRDGGSWGGGGVEGP

SEQ ID NO: 779056 - protein, 133 aa, Homo sapiens
SQAPGGIPGPEGEHQGAQSRLRLPPPVRQIPAEVRSPPPPPSPSPSSERPARPVCYEHPTPQPSALRYAILTPETWPRWRGDERQGVQHLLRAVNMEPDQYQMGSTKVFVKNPESVSVFEGQAEKERGRERKV

SEQ ID NO: 779057 - protein, 848 aa, Homo sapiens
TVSAPVVPQSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYVGSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLFPGNYVEKI

SEQ ID NO: 779058 - protein, 258 aa, Homo sapiens
TVSAPVVPQSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYY

SEQ ID NO: 779059 - protein, 316 aa, Homo sapiens
TVSAPVVPQSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVRPLPLPYPVPPRRPPGLQAVAPTLQHPGWKEPARTLIQGCRIPLSPASIHPLLTR

SEQ ID NO: 779060 - protein, 129 aa, Homo sapiens
PCWGLYENRNRVRADPRSPRPPSGLTPGNREASLSWLFGERAPRRAKLGPGALRRIRPAGSQPLPAPDAPTWRRCINGSESVGGRARQGETEPCAGSQRRPSTLRPYPARRHCSAVGSGVCLLREGRSH

SEQ ID NO: 779061 - protein, 31 aa, Homo sapiens
MALNVTIAVEQWAIPVGLLGPGWGAELFPWD

SEQ ID NO: 779062 - protein, 67 aa, Homo sapiens
VQIPSSWQTSDNMQIIRSHKDFTCMSTQMPSHIHMSRYPLVGKQVTICKLSEATKICFGGEPEQTRN

SEQ ID NO: 779063 - protein, 37 aa, Homo sapiens
EPCCLSVSVSKTAESLTIAGPWRERCHTSFLPPGGAR

SEQ ID NO: 779064 - protein, 47 aa, Homo sapiens
HRLPAALLTNSFLEKLHGSTHSHRPLRLQGRMPVFKSLLHNLPAVGL

SEQ ID NO: 779065 - protein, 94 aa, Homo sapiens
SDATARSISSRASLAIMGHIRSVSIFSVLLIPKHPAAQDLPVDDAIFMENICSKGLHKGGIDKHRVYRGQYWVEIIVNYAHGEFYHCSRRGVIF

SEQ ID NO: 779066 - protein, 120 aa, Homo sapiens [sequence omitted]

SEQ ID NO: 779067 - protein, 164 aa, Homo sapiens
RALTHRRLRRSRAGAPHAPDGRTAASGGAMASAAAGEAEETTRLRKPRFSFEENQILIREVRAHYPQLYGAQSRRVSVAERRRVWDGIAAKINGITSWKRTGQEVQKRWNDFKRRTKEKLARVPHSTQGAGPAAEDAFSAEEETIFAILGPGVAAPGAGAGAEE

SEQ ID NO: 779068 - protein, 279 aa, Homo sapiens
EFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKASYVQTEIFTEHTEFLLSEQDTTQILNSFSGTRHQLNGVFKRSRTRQAWLPGSKHFRHKDIVEFLAATQLNLPRHTGDLIWDCWGILGPGCHGEQYTPRDTTTTLKSRKESNCRFMVRVMGTYRPPHVRQPGSPCYVGSTGRRKLIQQRHSGIPEEPSPGNVDRRCGNT

SEQ ID NO: 779069 - protein, 112 aa, Homo sapiens [sequence omitted]

SEQ ID NO: 779070 - protein, 82 aa, Homo sapiens
SKSKKKTDAADKPRGFARGLDPERIIGATDSSGELMFLMKWKDSDEADLVLAKEASMKCPQIVIAFYEERLTWHSCPEDEAQ

SEQ ID NO: 779071 - protein, 137 aa, Homo sapiens [sequence omitted]

SEQ ID NO: 779072 - protein, 111 aa, Homo sapiens
LPLSSSPFPSSPSFPGTLPHPHVHPLLLGPPTAAVAHLCSALASPALCSLFFYYYYYTLSFRVHVTMCRLVTYVYMCHAGALHPLNRHLALGISPNAIPPPSPHPTTVPRV

SEQ ID NO: 779073 - protein, 94 aa, Homo sapiens
MIERACVPPSNVVTVADGGYRVMDGAADSAVQIIHRGQCLVPWDRGVGVSTRKNRTARHPETEPAVGRAGRAAGPGAPEAAEEAAPQRQEPVQP

SEQ ID NO: 779074 - protein, 50 aa, Homo sapiens
AIHRHLAIHRHLAINRHLAIHRHHIKIFSLIRSGIVRTEKGSLNHGAMKE

SEQ ID NO: 779075 - protein, 118 aa, Homo sapiens
NSRPRRRRRQKGGGEVEMRQEVEGRGRGSHELIITDKRCGVCGGSLSCIVYLCISLNFSRIKKLSIHGLVLPETHPMPASSQGEPSLHFHTHLTLLCTLNLESSKQGNPKPCWLLPTP

SEQ ID NO: 779076 - protein, 87 aa, Homo sapiens
SLFIGTSLFIGTSQFIGTSLFIGSHGHARSAWFQWRGGDKSLVGIDSKERGRGRNGDRQFFLSFSLKIYADMEWSLGRDIGSGNIIF

SEQ ID NO: 779077 - protein, 202 aa, Homo sapiens
MDWKAVAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKE

SEQ ID NO: 779078 - protein, 151 aa, Homo sapiens
MLCPTTDSHTSLGTRICLQSDSLPSQHALPWPGQCCPHPHEGGVGAAHVPAVRSASHRSSSCGDKLLCAALSFSSCVLQKALELSGPQVAFRSVDNANSSDHRQPWQAGLSVTKEYAQQRHGKTTNHLGTLRKKTRWADSTVLWGHNAQGL

SEQ ID NO: 779079 - protein, 106 aa, Homo sapiens
KKTSTTIKKKQNLKTQYNNYLHSIYIVLGILSNLEMIQSIQEDVGRLYAVTMPIYIEDGNICRFWYQGRSWNQSPTVAKRQLYAENFTALPQFRLFNLGLGFCPSW

SEQ ID NO: 779080 - protein, 103 aa, Homo sapiens
MKMVVKEKLKSKKESESQRIPAEPDLKLGEGEKVCEEEIGDWAPYVPERVEFPGNSKSTVFSSKKCAIEIKCWLSAARNSKEDTWREQSMEQEERDLLEQENI

SEQ ID NO: 779081 - protein, 53 aa, Homo sapiens
RYCCFHSDCKTVAGPFSSYDWICSYGKITLTKESTMCKNGTVLIMAKSVFHCD

SEQ ID NO: 779082 - protein, 110 aa, Homo sapiens
LCIAWLGLINVPKSVFFSPALLATPDPLHSSQPVLTLLHPNPNPSSTAVGTSPKLKIRLLLVTLARVLSPTPLTVLRIPMAHTACPGPATAWGSGPVTHRALFPSAPCIL

SEQ ID NO: 779083 - protein, 61 aa, Homo sapiens
LPEELTFKRQTPLPPHPFPVPAHGAWVEPSICVLMRFEQASQVVLRGWSPGHTEKPSSGGR

SEQ ID NO: 779084 - protein, 82 aa, Homo sapiens
ACSACCRLPAGRRLSWEGSEGWQGALLCSLGGSPWLFCMPRAVLSVEIYVGDDRLRFRLHQPDFRWTVPFSASVNTVVKRLT

SEQ ID NO: 779085 - protein, 194 aa, Homo sapiens
MANSFAARIFTTLSDLQPNMANLKVIGIVIGKTDVKGFPDRKNIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKILYNFRPEKRPEV

SEQ ID NO: 779086 - protein, 40 aa, Homo sapiens
AGGPGVLLLGGYVGHEVHHPVAVAKFVVIPGNELDKMVFE

SEQ ID NO: 779087 - protein, 88 aa, Homo sapiens
AGGPGVLLLGGYVGHEVHHPVAVAKFVVIPGNESPHCWGVPSTLSPPPTESPSHRCHVAPLKGEGPKEPPPFHGPSIKVPWWSTQKKK

SEQ ID NO: 779088 - protein, 139 aa, Homo sapiens
FFSLKTYSFHHRIEIGEASIILQTNASPPHVHIVNRVIYKIHFHLRRLKNDLSTKNPFQVHRTCEYYLIWKKDSYVESSWISGWALNPKTSVPVSDIWRIRCDDRGRKWSNVATSQGSQATPTTTGSRKDSLLKPQRKL

SEQ ID NO: 779089 - protein, 93 aa, Homo sapiens
ERPVDSIALSWEQNLPGLCTFNPAGSQLSAVRRKAFTLQFPGDCSQDAWVSTTDSSAEGLLRGNFPPEKHRNETAMSPVGEDDRLFTCSSQNL

SEQ ID NO: 779090 - protein, 75 aa, Homo sapiens
RGARGAEWGGVSPSQGPWRLMSWAPLGNHRKSAVLAVWNSHPKTYFELSKKVIVPTAFVPTSPCINSPQQHRARI

SEQ ID NO: 779091 - protein, 812 aa, Homo sapiens
KELSSCLAAGPREPVLGAGGPVLTMVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 779092 - protein, 648 aa, Homo sapiens
KELSSCLAAGPREPVLGAGGPVLTMVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTNFMDCPWECSKCQGVCPIIKPQRTGLGPMGLVKL

SEQ ID NO: 779093 - protein, 370 aa, Homo sapiens
KELSSCLAAGPREPVLGAGGPVLTMVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPKSKDRYFEG

SEQ ID NO: 779094 - protein, 853 aa, Homo sapiens
KELSSCLAAGPREPVLGAGGPVLTMVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 779095 - protein, 714 aa, Homo sapiens
KELSSCLAAGPREPVLGAGGPVLTMVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDIMITPPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 779096 - protein, 145 aa, Homo sapiens
AGSCPGQPDVSCTLGSASVLCLHARAGARCGQLSDTLPRAGRSCALSSLYWKAWPSQGPPAPVHSATGVRALSFPPGPGRSGQEELSSFFGRIEGASPGCTEGRRWSRRGSVQAVPGWMLESQQHLSRWLLGSSTSLPGHRGPGI

SEQ ID NO: 779097 - protein, 114 aa, Homo sapiens
SVKGKRLQARRWTQRGGSVSTLGGGLSAGGTSPGSEVDSAKGERLQARRWAQGGRNVSRLGGGLSEGGTSPRSEVGSARGERLQARKWTQRRGNVSRLGGGLSEGGTSPGSEVD

SEQ ID NO: 779098 - protein, 104 aa, Homo sapiens
CIAEQAEVAHNDSHGIIMDLSPKEMFSLNCTSQSVCHGHTMFRWSKQNSQMVEMLRNTARVPVIWKHGSIVAPQPQLIWPALGAKHKDLWKLLIALNKIKFGKE

SEQ ID NO: 779099 - protein, 335 aa, Homo sapiens
MTTVTVTTEIPPRDKMEDNSALYESTSAHIIEETEYVKKIRTTLQKIRTQMFKDEIRHDSTNHKLDAKHCGNLQQGSDSEMDPSCCSLDLLMKKIKGKDLQLLEMNKENEVLKIKLQASREAGAAALRNVAQRLFENYQTQSEEVRKKQEDSKQLLQVNKLEKEQKLKQHVENLNQVAEKLEEKHSQITELENLVQRMEKEKRTLLERKLSLENKLLQLKSSATYGKSCQDLQREISILQEQISHLQFVIHSQHQNLRSVIQEMEGLKNNLKEQDKRIENLREKVNILEAQNKELKTQVALSSETPRTKVSKAVSTSELKTEGVSPYLMLIRLRK

SEQ ID NO: 779100 - protein, 335 aa, Homo sapiens; identical to SEQ ID NO: 779099

SEQ ID NO: 779101 - protein, 335 aa, Homo sapiens; identical to SEQ ID NO: 779099

SEQ ID NO: 779102 - protein, 105 aa, Homo sapiens
VSTSPTDPCHIQLKALWWLLTPPEIKPKLLTMHLRPMRPGPHQHANLISLTLPSSHPGLLLFLKQAWHSPASGPLHLLLPLPGTHFSPLFPPGLLLLLQDLVKCH

SEQ ID NO: 779103 - protein, 76 aa, Homo sapiens
RIPECRLDSYPCHPRSMLIHQLPVYTDSRTRETDSTEMRQQEVRRKSEKGEGQKRGAPTSEYKLSKALSGPYTMHV

SEQ ID NO: 779104 - protein, 96 aa, Homo sapiens
MPDQDKKVKTTEKSTDKQQEITIRDYSDLKRLRCLLNVQSSKQQLPAINFDSAQNSMTKSEPAIRAGGHRARGQWHESTEAVELENFSINYKNERT

SEQ ID NO: 779105 - protein, 37 aa, Homo sapiens
MPSVPQFPIEENSFPTHIVSSQEFHKVSSEHCAKGSF

SEQ ID NO: 779106 - protein, 72 aa, Homo sapiens
GVQTRHCQGGELEGSGRVSGNGAWKGGSTSMNTNTAIRKRDRPDQEWEQGRKWQVSPRVIEILDAHSNVSLT

SEQ ID NO: 779107 - protein, 159 aa, Homo sapiens [sequence omitted]

SEQ ID NO: 779108 - protein, 198 aa, Homo sapiens
AGLPGKQRSHRQEGSGPAASSTTREAEVAGETPLLWGISMDIIKGNLDGISKPASNSRIRPGSRSSNASLEVLSTEPGSFKVDTASNLNSGKEDHSESSNTENRRTSNDDKQESCSEKIKLAEEGSDEDLDLVQHQIISECSDEPKLKELDSQLQDAIQKMKKLDKILAKKQRREKEIKKQGLEMRIKLWEEIKVRII

SEQ ID NO: 779109 - protein, 112 aa, Homo sapiens
LTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSP

SEQ ID NO: 779110 - protein, 143 aa, Homo sapiens
MGLLTFRDIAIEFSLEEWQCLDCAQRNLYRDVMLENYRNLVSLGIAVSKPDLITCLEQNKESQNIKRNEMVAKRPDVQFSTSSVEGIIFSPLSAHGNLEADYLVIHRRVHCWAFYFVLSCLYLSFCEYHIVIVIAAFYYVLKL

SEQ ID NO: 779111 - protein, 103 aa, Homo sapiens
FPGRCKLVLTSEPPYVQFLLPSLLSPKTLTGSAPLLILVSVRILQMSPCCSPSLVLLHPLPSAPSFLVALSIIFCIHCLSPSNVSFLEAETSSVLLIFVLPKL

SEQ ID NO: 779112 - protein, 127 aa, Homo sapiens
SRTLKVNQRITVARGAFIQEKQLNLSKNSGLCELFFFLRQGLAQAGVHQHQHGSLQPLHPSSSDSRASASQFKRFSCLSLPSSSDSPASASRVADYRRHHARLISVFLGEMGFHHVAQTGLEFLTSI

SEQ ID NO: 779113 - protein, 208 aa, Homo sapiens
SGGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEAKPNLTWRDMQHLVVWTSEYDPLANNPGWKKNGAGLMVNSRFGSGLLNAKALVAFELNPGPGGACLS

SEQ ID NO: 779114 - protein, 106 aa, Homo sapiens
TLGHWVRGGGRARRTTFPIMPSTAVLTKQKRKSIPSPGSPAAPGEGGAGTADCVGDFALSSWSAVVFVCVLLSCTALVQPSVAFHETSIVRACENPVLCLQLDRFV

SEQ ID NO: 779115 - protein, 424 aa, Homo sapiens
MECALDAQSLISISLRKIHSSRTQRGGIKLHKNLLVSYVLRNARQLYLSERYAELYRRQQQQQQQQPPHHQHQHLAYAAPGMPASAADFGPLQLGGGGDAEARESAARHQLHQLHQLHQLHLQQQLHQHQHPAPRGCAAAAAAGAPAGVRGGRSRSCPGAPRSSRRTGAPHRGQPLEPLQPGPAPLPLPLPPPAPAALCPRDPRAPAACSAPPGAAPPAAAASPPASPAPASSPGFYRGAYPTPSDFGLHCSSQTTVLDLDTHVVTTVENGYLHQDCCASAHCPCCGQGAPGPGLASAAGCKRKYYPGQEEEEDDEEDAGGLGAEPPGGAPFAPCKRARFEDFCPDSSPDASNISNLISIFGSGFSGLVSRQPDSSEQPPPLNGQLCAKQALASLGAWTRAIVALPLGAELGASGGRRLMFYKL

SEQ ID NO: 779116 - protein, 405 aa, Homo sapiens
MECALDAQSLISISLRKIHSSRTQRGGIKLHKNLLVSYVLRNARQLYLSERYAELYRRQQQQQQQQPPHHQHQHLAYAAPGMPASAADFGPLQLGGGGDAEARESAARHQLHQLHQLHQLHLQQQLHQHQHPAPRGCAAAAAAGAPAGVRGGRSRSCPGAPRSSRRTGAPHRGQPLEPLQPGPAPLPLPLPPPAPAALCPRDPRAPAACSAPPGAAPPAAAASPPASPAPASSPGFYRGAYPTPSDFGLHCSSQTTVLDLDTHVVTTVENGYLHQDCCASAHCPCCGQGAPGPGLASAAGCKRKYYPGQEEEEDDEEDAGGLGAEPPGGAPFAPCKRARFEDFCPDSSPDASNISNLISIFGSGFSGLVSRQPDSSEQPPPLNGQLCAKQALASLGAWTRAIVAF

SEQ ID NO: 779117 - protein, 350 aa, Homo sapiens
MECALDAQSLISISLRKIHSSRTQRGGIKLHKNLLVSYVLRNARQLYLSERYAELYRRQQQQQQQQPPHHQHQHLAYAAPGMPASAADFGPLQLGGGGDAEARESAARHQLHQLHQLHQLHLQQQLHQHQHPAPRGCAAAAAAGAPAGVRGGRSRSCPGAPRSSRRTGAPHRGQPLEPLQPGPAPLPLPLPPPAPAALCPRDPRAPAACSAPPGAAPPAAAASPPASPAPASSPGFYRGAYPTPSDFGLHCSSQTTVLDLDTHVVTTVENGYLHQDCCASAHCPCCGQGAPGPGLASAAGCKRKYYPGQEEEEDDEEDAGGLGAEPPGGAPFAPCKRHSGLSWGRAGAGG

SEQ ID NO: 779118 - protein, 253 aa, Homo sapiens
VIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILQDINDEKSLSHLKSESKEPLKDSEFESLKTCNKSFEEDPKWSNPEPNDLKEENEDEIPTGMPCLESVTIGDDIWDEN

SEQ ID NO: 779119 - protein, 107 aa, Homo sapiens
ISYYRVRQTFSLMGEWETGRLIIHILDLVGTTCDLCCIVFFVSPPPPLTILKCEELSTLTQGHSLYNLGAVGREGRMVEGQVMVESKHFTMLLKAFQDLDISLVLLS

SEQ ID NO: 779120 - protein, 352 aa, Homo sapiens
PRDRGRRGLEMSNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSLPDNIPCIPPSSVDSTDSFFPSRKPPMSEKSRAQVASENGGRWAWPMPGWGPACPKKMPNCSPTAKNAVYEEDELEEEPRSTGELRLWDYRLLKVFFVLICFLVMSSSYLAFRISRLEQQLCSLSWDDPVPGHR

SEQ ID NO: 779121 - protein, 70 aa, Homo sapiens
QDKGLFNSSNCRGSLVPTISGELPEMLFLWKKYLTPYCRFLQDLLPGHVLILPGVPYFSARAAVMLLELG

SEQ ID NO: 779122 - protein, 353 aa, Homo sapiens
TALSRSEATEEGGNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSLPDNIPCIPPSSVDSTDSFFPSRKPPMSEKSRAQVASENGGRWAWPMPGWGPACPKKMPNCSPTAKNAVYEEDELEEEPRSTGELRLWDYRLLKVFFVLICFLVMSSSYLAFRISRLEQQLCSLSWDDPVPGHR

SEQ ID NO: 779123 - protein, 72 aa, Homo sapiens
VVIPVVSVQMIKKHKMARLLPNGLAITTNTSQKVSALGPCSLVSLPLPALTAHSLTRAHSQVFISPHPAALQ

SEQ ID NO: 779124 - protein, 97 aa, Homo sapiens
MPMDNYSVYHRAFPCQVSCSAPKLSRKGGLEPFSGPKETTLERKLWGADSLCEPPAPSIYARRRTCRKRWLAEFLCQAGWKDWEPSPQGVTAAQGHW

SEQ ID NO: 779125 - protein, 57 aa, Homo sapiens
PGNEPFRVLIGFGGFPYLIPDPRTAHGFLSAFQFEEAVLCYVDSVSFRCLVLHFSDL

SEQ ID NO: 779126 - protein, 69 aa, Homo sapiens
SILTLPDLSGPHCRLCLPRCMTVPTQHRGPVVLKEPEKQQLYDIPASPKKEDSITPRRAPDLLRLTTLV

SEQ ID NO: 779127 - protein, 132 aa, Homo sapiens
VESAWFLQRRGLKWSGGCVWCLALDLHLDRDGLLSRLVNGELWGELSRDLLRRLLYLHLDLNLLRLLNLDLLFLLGLWLNTGGDWTGKFKQRPSHFSAVCVYAVPTLLVHHGSGGCLQGTHAHGVLGSRGIV

SEQ ID NO: 779128 - protein, 47 aa, Homo sapiens
MSLFLQTYTSYNQVHMFTSAGLNSVPSSPDLLLLLYFLFQFHLAYVL

SEQ ID NO: 779129 - protein, 65 aa, Homo sapiens
LCYQGRCSRAGGCIPRVDVGEMKKMAMTAVVTKTRGTLALETKAENKQKQESGRKLNTGADDQTE

SEQ ID NO: 779130 - protein, 72 aa, Homo sapiens
QVDQLDEECETRRVARQWDITLVSSERITRDTLSWGIVVMHLLVHGLSCADTACSAWKQYAYDVLGMAETVS

SEQ ID NO: 779131 - protein, 75 aa, Homo sapiens
IARAERSGIMVALGEPMRSSLFVAVSVYLTSKRTSGQEGGDSIRTVIIVVVFNKQTCHETCHRGPLFHISPKPHR

SEQ ID NO: 779132 - protein, 48 aa, Homo sapiens
GCCLGEGGSFMFTISILKVGTSRGYDSQREWQLTDAGKRDFQMYAFHA

SEQ ID NO: 779133 - protein, 191 aa, Homo sapiens
RVVPPLAPASPAPRCRHRGPWAESAGGPALNRRKDVPVRSEETSDSKTEGWSKNFKLLQSQLQVKKAALTQAKSQRTKQGTVLAPVIDYNEVAPQMTGQIVDTPPHVPAGLKDPVPSGFSAGEVLIPLADEYDPMFPNDCKKVVKRQRGRTKTAGAGKTEEIEEREERHKYRHDAREFSRSSDPDSDEDED

SEQ ID NO: 779134 - protein, 113 aa, Homo sapiens
MSVLVAGMPGKGSTEVRQVPWLPPGEQPAHRCPSQAPGWPPPRLLHPLFLLQPVPRAAQGQVPPGAQTYFLSSCPLPACLSPGPAGSPGSSHAPPHLPQHQVPRQLLPSRLHT

SEQ ID NO: 779135 - protein, 77 aa, Homo sapiens
SRNKVCSSPLDRQTNALVPSSDAETCLHYQTGQVSSAASPSTPTVAAKWGSWPQGGRKHLLGPVERRLIELEVVYVE

SEQ ID NO: 779136 - protein, 119 aa, Homo sapiens
MDLSSGPLGSSTICDISGCHAVGTLLQDQPGRSSWTVPAGKVVHGSDSPQSHDSYNLALSQPGRQQQMDPLSADAEPRRMGTYGQLQLHSTVKTADFHKSLSCASAYSPGGSPCQFTDV

SEQ ID NO: 779137 - protein, 98 aa, Homo sapiens
DALSRQLSGPKEQKVPALPVVKRKDMTSNPTTLRELSLSQMVCIFLPSRLPWPFSPQRGQVHYIMYLTMVPLPSFEELSGKMFGKNDVGRIKGLCRIF

SEQ ID NO: 779138 - protein, 106 aa, Homo sapiens
SSLPASRLGCEREPPGRSSLEVPVPTAWPHLMSHSPKVSFHSANLQEHRPGHWLSGPFKDQKVKHSPVGAGQLGRDLGLWVVKSQPWAHTCQPDVTDRLLGGLGLQ

SEQ ID NO: 779139 - protein, 86 aa, Homo sapiens
MCCDPALPQSPGHSCPLCYQLPSPNYTSLDLAIQKPKAILALGESRFIQGLYPNALGLEAVSSWSLPPGHLHQAADRVLEETAATT

SEQ ID NO: 779140 - protein, 189 aa, Homo sapiens
MGNLSCCIQGDSKKPSQRRVKRQPYSTTKVTSGSTFNENTRRYAVHTNQCRRPHGSRVKKKRYPQEDDFHHTVFSNLKDWTSFSPTLEASEESLVQQGQRRWREAVNVRVVQVDTSEAVNLLPMRTPYTNHYRGCPQHDITNEDATRGMAKEDAAKACPKRTPPTDRQRGRARESPRGGHRQEVNKSSA

SEQ ID NO: 779141 - protein, 496 aa, Homo sapiens
MAGEITETGELYSSYVGLVYMFNLIVGTGALTMPKAFATAGWLVSLVLLVFLGFMSFMTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHGQGEGHPPLADFSGVRNLFGVCVYSFMCQHSLPSLITPVSSKRHLTRLVFLDYVLILAFYGLLSFTAIFCFRGDSLMDMYTLNFARCDVVGLAAVRFFLGLFPVFTISTNFPIIAVTLRNNWKTLFHREGGTYPWVVDRVVFPTITLVPPVLVAFCTHDLESLVGITGAYAGTGIQYVIPAFLVYHCRRDTQLAFGCGVSNKHRSPFRHTFWVGFVLLWAFSCFIFVTANIILSETKL

SEQ ID NO: 779142 - protein, 496 aa, Homo sapiens; identical to SEQ ID NO: 779141

SEQ ID NO: 779143 - protein, 349 aa, Homo sapiens
MAGEITETGELYSSYVGLVYMFNLIVGTGALTMPKAFATAGWLVSLVLLVFLGFMSFMTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHWHRLRTCAKKLLMMAGIDDCYTSARGCTATLGNFAKATFDAISKTYSYLTPDLWKETVFTKSPYQEFTDHLVKTHTRVSVQRTQAPAVATT

SEQ ID NO: 779144 - protein, 134 aa, Homo sapiens
MAGEITETGELYSSYVGLVYMFNLIVGTGALTMPKAFATAGWLVSLVLLVFLGFMSFMTTTFVIEAMAAANAQLHWKRMENLKEEEDDDSSTASDSDVLIRDNYERAEKRPILSVRKSWGSRGPALPSGPQGSL

SEQ ID NO: 779145 - protein, 314 aa, Homo sapiens
MAGEITETGELYSSYVGLVYMFNLIVGTGALTMPKAFATAGWLVSLVLLVFLGFMSFMTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIDGPPGSVMGRAEEDASPAWPRSRCRCGGKLKLNSLYPTSATCMAPDAPGAGQVKVGVNFLCLPPHRSTRPT

SEQ ID NO: 779146 - protein, 496 aa, Homo sapiens; identical to SEQ ID NO: 779141

SEQ ID NO: 779147 - protein, 496 aa, Homo sapiens; identical to SEQ ID NO: 779141

SEQ ID NO: 779148 - protein, 104 aa, Homo sapiens
DPFLTPYTKINSRWIKDLNIRPKTIKTLEENLGNTIQDIGMGKDFMTKTPKAMATKAKIDKWDLIKLKSFCTAKETTIRVNRQPTEWKKIFAIYPSYKELISRI

SEQ ID NO: 779149 - protein, 232 aa, Homo sapiens
GQMGEEHGWGLRPSRQGERGVTVKEGLRLQRRSGSRDGSLSSEEGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 779150 - protein, 241 aa, Homo sapiens
WSGSFPLENTELANVGANQVTVRKGEKDHTTHCHASDHANQLSIHIPGWSYRAGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 779151 - protein, 249 aa, Homo sapiens
ERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPIPHQRKESISMEALT

SEQ ID NO: 779152 - protein, 244 aa, Homo sapiens
PSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 779153 - protein, 49 aa, Homo sapiens
MIWIPDLRNQNAPRFNSQTCLLYFAFYVNAFGNTIIGCADGGSKDLMVL

SEQ ID NO: 779154 - protein, 138 aa, Homo sapiens
VSPTSISVSPFLSVSVSPPLLSVSPPLPLSLSLPHFSVSVSPPLLSVSPPLLSLSLLYFSLSLPLPHFYLCLFPISISDCPPLLSASLPPFLSVSVSTPISVSVSPPISLHLCLSLLSLTPPLSPAPWTKPSGASAVP

SEQ ID NO: 779155 - protein, 462 aa, Homo sapiens
GLLPLTLCLPLPDQDRLALGTEEGLFVIHLRSNDIFQVGECRRVQQLTLSPSAGLLVVLCGRGPSVRLFALAELENIEVAGAKIPESRGCQVLAAGSILQARTPVLCVAVKRQVLCYQLGPGPGPWQRRIRELQAPATVQSLGLLGDRLCVGAAGGFALYPLLNEAAPLALGAGLVPEELPPSRGGLGEALGAVELSLSEFLLLFTTAGIYVDGAGRKSRGHELLWPAAPMGWGYAAPYLTVFSENSIDVFDVRRAEWVQTVPLKKVRPLNPEGSLFLYGTEKVRLTYLRNQLAEKDEFDIPDLTDNSRRQLFRTKSKRRFFFRVSEEQQKQQRREMLKDPFVRSKLISPPTNFNHLVHVGPANGRPGARDKSPAPEEKGRVARGSGPQRPHSFSEALRRPASMGSEGLGGDADPMKRKPWTSLSSESVSCPQGSLSPATSLMQVSERPRSLPLSPELESSP

SEQ ID NO: 779156 - protein, 111 aa, Homo sapiens
MANIHLYNNYAELQTGSIYSKPTQLSTSYSSHYITSFSHCLRRHYSPGGLPCMRRLNIPKLVLSYLTLTVALSHAGSRDFFSPLPLFSATHLLPPLLHRSTLLHPNQPPSM

SEQ ID NO: 779157 - protein, 62 aa, Homo sapiens
RVAEVARVTARLVTEQSLAPASPAQPPFISSDASKFKMQCHQKPLTQADGSATHSHPLGMGS

SEQ ID NO: 779158 - protein, 69 aa, Homo sapiens
VPRVFIDATQCWADTALSGIESRHEKFLSFQFSFTPHWVKGRISIWGSCAVNICQTLADVICLFDQEQI

SEQ ID NO: 779159 - protein, 107 aa, Homo sapiens
FNNKRNEVLIHATRVYLESIILSEGNQAQRPHVVPFHFYKISRIGKSVEIESRLMVASGCGGLGVTANGYEFSYWCDENVLELEIMMMFVYIICECTKSYLIVYFKE

SEQ ID NO: 779160 - protein, 88 aa, Homo sapiens
EPPPSDAMVSSCCGSVCSDQSCGQGPRPGELLPPQLLPDHLLQDHLLPPQLLHFQLLQAFLLYLQLLQTQLLQDHLLPPQLLHFQLLQ

SEQ ID NO: 779161 - protein, 73 aa, Homo sapiens
MVPGASADWQEDLGGGVELSQLPISTYSRARNRFPDGRRGSQVLSSTCPGCMQVMRSRDRAQTESGPGRRRRA

SEQ ID NO: 779162 - protein, 74 aa, Homo sapiens
LFLCGSWDSNGRQEILYICERKFLWPWDGQEPHVYLKSCDILVCSMGAPKVTFFQMPEDAIEKCVPSCNTLFKF

SEQ ID NO: 779163 - protein, 127 aa, Homo sapiens
RRTLSSFGGVPTSSSSAQALSPQGVPLQTRWRLRDWQVSVGPANLSGVSMKQAGLVSAPTSFSSCCLWPCILASERVQQLGSGWLPASQSNQKTSLNDEGALAQASACSCAHTRKHTHTTCTQESHQ

SEQ ID NO: 779164 - protein, 756 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEEQSIMAHMGIDSGTTNIFDEVDKSDFKTDFGSEFPIFSPMPGESCENANTSLGRRMSVNCEKLVKREKPRELIFPSNYDLLRHLQYATHFPIPLVSHCFS

SEQ ID NO: 779165 - protein, 721 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLVSHCFS

SEQ ID NO: 779166 - protein, 34 aa, Homo sapiens
MQISTACVQASRGCRASRGPDQPDRGDNTFARGT

SEQ ID NO: 779167 - protein, 31 aa, Homo sapiens
MDVFVVCNHYGLNHGLRICPNNRNFVREGIN

SEQ ID NO: 779168 - protein, 83 aa, Homo sapiens
RLAGKQGKSWHWKTDATSVNFCSQAPNDHLMQQPNTQRSSNATAKHPVIIYWNRLIMQQYHVTVCAIDRTEHLMREAKTQGVS

SEQ ID NO: 779169 - protein, 144 aa, Homo sapiens
LPHPRPITEGDRAGQNQAWQPPGLCPMDAGVSAEQGPPLPVPALRCLGCCVTLVSFHADTCGHNVGVCWTSGPVLGAGHVATAGLAPAPGSGHSLSLPPTPTENLVAMREQESRKLDRAQTPDGGDPDPEHVGVSFGEARQGGC

SEQ ID NO: 779170 - protein, 79 aa, Homo sapiens
LNGRNLGPGSSGSQSQSPWPLRVIRRDPGRSVSASVLDQSLGAQRAAGDLGVWGGTTQQDQNLEGGSCPWWPAGHAGLP

SEQ ID NO: 779171 - protein, 33 aa, Homo sapiens
MQLEDTIYGPGTRASPDIETACTLIMEFPVSRT

SEQ ID NO: 779172 - protein, 146 aa, Homo sapiens
ISAHCNLLLTTTSSSLQPPPQCNLLLTATSSSLRPPPHCDLLLTATSYSLQPAPHYNLLLTATSSSLQPAPHYNLLLTATSSLLRPPPHCNLLLTATSSSLQPPPHCNLLFTTTSSSLQPPPHCNLLLTATCSFWVQGILLPQPPK

SEQ ID NO: 779173 - protein, 38 aa, Homo sapiens
MRRVIQVCEGQLDVQTEGTGAISGYPTTQFMTQVVIQG

SEQ ID NO: 779174 - protein, 133 aa, Homo sapiens
RPVTALGPVTEHPGPPPLRRAGRPRPVTTLDLSLSIQDLLAMQAGPTRSPLSDLAGSSLLLEKGVVSGTSHPHGQPCGSYHQSPDTVTSAQLQPSLGGGSGSSLDFLIVLGLDQGQGRFAPLSPSQAAAKENN

SEQ ID NO: 779175 - protein, 108 aa, Homo sapiens
STLTANPVEILLHLLYRESQGFEVKQYSHDHAAQGHTDGISLPVSGSQIYIQVNATLLMASLSPGQLCLETPLVSYTLQMPISFLPKLVLFGISWRAPPTTAQARRLT

SEQ ID NO: 779176 - protein, 52 aa, Homo sapiens
MEWKLQGREQKEGQRMTGDCGKQRITSYEHKHALIYPEGPTIEPGSEFLCKM

SEQ ID NO: 779177 - protein, 76 aa, Homo sapiens
GPSPLPASQNGARLPTSAAFGHRDPVPRSGEVGLGLGHLDCNWELCRTPGRFQTLNRSHRQGDLQFRGTTLGWPCI

SEQ ID NO: 779178 - protein, 121 aa, Homo sapiens
MVPSPLTSAATAPRGLAAKARRGCGDEGRGGRAAGGAPHIPPRGGGARGVRGRRACRGGQSRGRQVRERKRTGPGGRKPEQRRTIPGAAACGSATPRHRQLGQGGGREGGTGTPRDGSVGV

SEQ ID NO: 779179 - protein, 103 aa, Homo sapiens
VDAHHQAGPPGQGHEDQVPGGELSLLPPIKESEIIDFCLGGSLKDEVLKIMPVQKQTRAGQCTRFKAFVAIGDYNGHIGLGIKCSKEAATAIRRAIILAKLSI

SEQ ID NO: 779180 - protein, 210 aa, Homo sapiens
PAGSRAGWGSPGRAGSRRARPRRGGGGGSGGGGERRGCPGAMWTGGRRPGRLRRAASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDF

SEQ ID NO: 779181 - protein, 85 aa, Homo sapiens
FRKQSDPLSLLIQCEKSADLLDDVLAVSSLLDTFRTPAHSHSLPQPTQNCNWKSKRIQKLAKAGQHFSQKVSASLKPADSQITII

SEQ ID NO: 779182 - protein, 130 aa, Homo sapiens
LEDLFGAFWTHSWGLYDLGQIPQPLQPCSNSTLLRELLRKCKVFSVCYYHIPITQMGQLRSAQRGKDACPAWHKSCVQISKQVYWVLVARGHPALLELCKVSSPSLLCRTQPENPAGSAQILSQQTQSTW

SEQ ID NO: 779183 - protein, 80 aa, Homo sapiens
SGDLLAASCLVSGQCKPGLWGLISGDLVSWGLVLAWSAWAGALVTRSRGAIQWRTGHMGPSQQTLVGVSSSVRSLSVGPW

SEQ ID NO: 779184 - protein, 106 aa, Homo sapiens
KLGHLSTDSAPVVDSRPNGVSSLALTPLHFLAVAGERMPLGRGAESLALEERGWEHLGDCLSQLQVNPGMGWGHRAGYQQSHTHMCVRTHTHTQAYSYIRTKCKFK

SEQ ID NO: 779185 - protein, 115 aa, Homo sapiens
TPSSFSSKRTYAGGWDLPQGLSKETRPRCNASAVDHTRARPKTPNHSPSSPASQTAGFSKPSFLLSVSSAELHVPLLLLPILPFFCPQNTSSYPSLVPGSLSPFFFFFFSLLLSL

SEQ ID NO: 779186 - protein, 66 aa, Homo sapiens
GGVNGPEAVKWPRTVVALHMGVPFIFFSISLVIALSMQGPNIITRHTGKRGPSRELTRSKTKTRIH

SEQ ID NO: 779187 - protein, 46 aa, Homo sapiens
MAHTAKIGQQHPKTRVFLSQLLPARASACDKHMTCLQPPSLGTTSF

SEQ ID NO: 779188 - protein, 51 aa, Homo sapiens
MAGAWQVSSSCYPFLVHSKTLLAALVGSRARRSDSAKGAWFIQHLGLSSVE

SEQ ID NO: 779189 - protein, 115 aa, Homo sapiens
HEDLLFVCHFFTLKFRDLSMLFCSCRSFILIVSISLRECTKMCYSSVDGHLSSFQVWVITKCCYELSRTYSGEHIHIHFSRPFHLKVKFRSRNLLRHIYSTLVDGNQLSKTDVLR

SEQ ID NO: 779190 - protein, 70 aa, Homo sapiens
TSCMSGGPALTATHPLVSLSEPAHQWVGHSAVTACSAGRYLQQDRAANARRRQGGGGRRSRGTRRCWSDR

SEQ ID NO: 779191 - protein, 59 aa, Homo sapiens
MSLTFRRPKTLRLRRQPRYPQKSTPRRNKLGHYAIIKFPLTTESAVKKIEENNMLVFTV

SEQ ID NO: 779192 - protein, 34 aa, Homo sapiens
LLPARSCPRCVWWLICGFLVEALKKSRSLVVHLS

SEQ ID NO: 779193 - protein, 76 aa, Homo sapiens
MGIVVSKIRRANETVRLESGVISPLTDEATLQKGSWSLLKDLKRITDSDVKGDLFVKELFWMLHLQKETFATYVAR

SEQ ID NO: 779194 - protein, 141 aa, Homo sapiens
LIMGDKKAGFSVFWADDGLDTGPILLQRSCDVEPNDTVDALYNRFLFPEGIKAMVEAVQLIADGKAPRIPQPEEGATYEGIQKKENAEISWDQSAEVLHNWIRGHDKVPGAWTEINGQMVTFYGSTLLNSSVPPGEPLEIK

SEQ ID NO: 779195 - protein, 130 aa, Homo sapiens
HLPGSSDSPASASRVAGTTGMRHHAWLIFVFLVKTGFHHVDQVGLELLTSSDPPALACQSGGITGVSPHAQPIQPISDYCPAHFAYVYDVSFSALLVSSLLFLCPFKSSSMKLSPTASATASAYTVLVLP

SEQ ID NO: 779196 - protein, 283 aa, Homo sapiens
TRIVQRLPVAVEGQWWRRKPKSMLMLMLVAAVTMWLRPLVTAQLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNHREGHVQVLRSPPQPEFGLSFDYNGTLDILIAPGQRGILLLWFEN

SEQ ID NO: 779197 - protein, 116 aa, Homo sapiens
EVSVAQGRGGNSSRKRGPTERTAALGEARLLPDASTRNMDLSLTKTVYRDKKPTQHKQSCLLLAFKIVRGVTLSATVSRLANPSLGPQMQTPEERPMPSAGPAILGPPRARQAPSL

SEQ ID NO: 779198 - protein, 156 aa, Homo sapiens
KSGANSGLHCTFPYQSDLPALLIHTFLSSILSSNTLKLIYASGLDGHYRKVQIVLSAQLSKLRVLLNTRLRSSKDMLEAALLFSETKLMSTTHCWAFLSLHICHNNLIFKKPTTDNNYNNYEKLALVGQAQWLMPVIPALWEAEVGGSPELRSLRP

SEQ ID NO: 779199 - protein, 208 aa, Homo sapiens
MGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQGHLQDGFSMMKMPEDESTPEKRTEKIFRQMDTNNDGKLSLEEFIRGAKSDRPSCVCCSATPAAPPVLRGARVPFPPSLHRPL

SEQ ID NO: 779200 - protein, 75 aa, Homo sapiens
LKEKVVGGRALQSSLCFLTAPVHLQRFFNGAEDHLLLDHRCLRRIKFYSLGIRPIFYSLANFSNFSFLLYKLMFS

SEQ ID NO: 779201 - protein, 134 aa, Homo sapiens
GPKITKLREESSWELLRANLPPVLFKVIPLLTEKNAYLIASFGKANQKLKRVQLFVSHLPVTWKPPPCPAFASSCPTFLGQTNVHFTYVDCFSCLSKMYKTKLCSDHLGHMSSGPLEAVLQVHILNLRKINFLN

SEQ ID NO: 779202 - protein, 199 aa, Homo sapiens
MGKVKVGVNGFGRIGRLVTRAAFNSVKVDIVAINDPFIDLNYMVYMFQYDSTHGKFHGTIKAENGKFVINGNPITIFQEQDPSKIKWGDAGAEYVVESTGVFTTMEKAGAHLQGGAKRVIISAPSADAPMFVMGMNHEKYDNNLKIVSCAPMFVMGVNHEKYDNSLKIISNASCTTNCLAPLAKVIHDNFGIVEGLMTT

SEQ ID NO: 779203 - protein, 66 aa, Homo sapiens
REEVPMASLPLLPRIGEEEEFSAKVGARVKQRQHIHMHWTGKWGYLKVVSKYGLRKEKETRLKRNK

SEQ ID NO: 779204 - protein, 129 aa, Homo sapiens
RSKSGRCGPGQGWAFAGGVLGPGEGQAVHREPLPGNSRLLSRGLGAAAGTAGKPPPAARRGRGFRWGSHRDLAAQGSAASARRWRSSLRDPGWLGPAVSAHARRRGLRTWVRAPCPPPTGPWPRAPRPC

SEQ ID NO: 779205 - protein, 131 aa, Homo sapiens
PFHLLVPPFLCPSIIHPSIHPSIHPSTHPPPTHPPAYPCCLSFLPSGLPSIHPSAHPPTHPLAHAPACPSFHLSFYPSIHPSILLTPPLTQSLLPSDSFMAHLRMGVLTCTTDEAHWELLPRGGALLPSLM

SEQ ID NO: 779206 - protein, 151 aa, Homo sapiens
RSQMVPGQAQPQSPEMLLLPLLLPVLGAGSLNKDPSYSLQVQRQVPVPEGLCVIVSCNLSYPRDGWDESTAAYGYWFKGWTSPKTGAPVATNNQSREVEMSTRDRFQLTGDPGKGSCSLVIRDAQREDEAWYFFRVERGSRVRHSFVNNLF

SEQ ID NO: 779207 - protein, 118 aa, Homo sapiens [sequence omitted]

SEQ ID NO: 779208 - protein, 191 aa, Homo sapiens
AGRSGLRDTLGWGTLWTGAPSGLRDALVCGTLGTGGHSGLGDPQGCGTLWSAGHSGLGDTLDWGTLRVAGRSGLGDPQGCGTLWTADPSPTPSLFCPIRPLCITWGYNRLALWLQLCFRVPGASNWVLQELRQSPCFAFILRACPASSREKPLRYDLYRNHTLSPLSVSQAGVQARSGLTAASTPWLKPPT

SEQ ID NO: 779209 - protein, 88 aa, Homo sapiens
GSGGPVLGSPGGLLGCMQWLRSARWMGRFLNPWALVMLWAMAVAVTRQPFVSRVVHTGVGSGYNRLGGPVSRPPVGACRRLPAVVVAA

SEQ ID NO: 779210 - protein, 358 aa, Homo sapiens
LGAFCVQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTV

SEQ ID NO: 779211 - protein, 205 aa, Homo sapiens
GFTRAMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPP

SEQ ID NO: 779212 - protein, 147 aa, Homo sapiens
VSGRACHRDEAPRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPP

SEQ ID NO: 779213 - protein, 38 aa, Homo sapiens
MSTPGQPHVRGVGGGKYQRQGDQVERPRHSQAEGGGGP

SEQ ID NO: 779214 - protein, 118 aa, Homo sapiens
NRDKALFQSILVQRNRQPHLQRPVLCTALTACALPSVQLGKSNHQATMPQLPDPPSSPQMSVFLLSPRDYEESYGLSCLKTYACVFTYTQAHTHAVLYIQLQEVRKALDPIPIPLGDL

SEQ ID NO: 779215 - protein, 187 aa, Homo sapiens
LPVAMGVFYVDTSRDTESLDFELQIVGVGVSAALPGRMEGASASILTFLLKELAKHQEFSLRLLSGPLSLRGEKFFRKVSSFLFIPRDHFTHPFFASRVDGTVERGNPALWLCLSSPTGTRATKATKDPTLSSVQASQLEEARRQRPRGHQEAFEPAERAWEHNAERRSNHCFSMGWESGVGRVVGI

SEQ ID NO: 779216 - protein, 134 aa, Homo sapiens
GRGGDRPTVLFGPPKGLLLLVRGAPLSSCARYETLSVSREGERRPPQVLFGPPRALLLRLAREGTPFIPHPETPSAPQARRRRPPQSSTPQGYVFCTPGRRKAGFPPCGSGWGHPSSFRIPKAPHLHPGRGTLR

SEQ ID NO: 779217 - protein, 69 aa, Homo sapiens
SKAMPNWFKLKRPFNLKSGHNSDQLSCQEVISADELPNNGKCLLMALQIISLKVAVMSPAESESCWEGH

SEQ ID NO: 779218 - protein, 111 aa, Homo sapiens
TVDISSAQWHCWEVLTVPIQGAGSRSLTADQGLGFPVDHRSKNLQGPASPPSPVFPTLARPSRCRNMQAPLQDCGRSVSLRLACVLAPLTTSSTGCHLQLPQDKGKAREDS

SEQ ID NO: 779219 - protein, 63 aa, Homo sapiens
MDVNPESPAKGCYLTPGDCREYQEVSGSDPEKVGNQPRASPAHSTTPVYFVPAFSSAQEKNPL

SEQ ID NO: 779220 - protein, 88 aa, Homo sapiens
RRCKVTPIAMAPLVPKAPGKAHFLDTGCVPRDARELPVAGGIQVDRLTQQHAVPRYIGQNLGTQAAQCTSIHHLSSPSSCFLHYSTSK

SEQ ID NO: 779221 - protein, 71 aa, Homo sapiens
SVNGQSRKTHRWWDRNSNSGRVTSETTMLFCLATEKTYVNVLCRLLAVHVSAPIMVNIFIGHHINPSAPIF

SEQ ID NO: 779222 - protein, 130 aa, Homo sapiens
MLSYLRAQLRKAEKCKLMKMIIVGPPRQGKSTLLEILQTGRAPQVVHGEATIRTTKWELQRPAGSRAKYVESVEFNVWDIGGPASMATVNQCFFTDKALYVVVWNLALGEEAVANLQFWLLNIEPRPHTT

SEQ ID NO: 779223 - protein, 85 aa, Homo sapiens
SRRREWHRALNGIERRCNGPEALNGPEALTGPRLPTVCSGFQSYNLPAYAPYLPCEVRSSGRGRLSTDMSHNHLLRGWGVAMYRA

SEQ ID NO: 779224 - protein, 96 aa, Homo sapiens
ASTNILGWNGFWGVGHGYISIRQVQQRKRKARTSGSLQDMILVMDYGVLTSQPWTSHGWLLVHGWLLVHGWLLVHGWPLVHGWLLVHGWLVRWNGI

SEQ ID NO: 779225 - protein, 273 aa, Homo sapiens
EASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDP

SEQ ID NO: 779226 - protein, 155 aa, Homo sapiens
EASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPLPFDPDISVRGSETQSAAIDTAAPALIYLYLPSHTRA

SEQ ID NO: 779227 - protein, 76 aa, Homo sapiens
SVSVLSVCPTLHGVAAVASVSVLSVCPTPRGVAAVASVSVLSVRPTLHGVAAVASVSVLSVCPTPRGVAAVASSAS

SEQ ID NO: 779228 - protein, 76 aa, Homo sapiens
EVYYSSRLVRGIQVAVCGAYCDKSMYPSCGYSGTVAFNACVIRISHIDISAQFVGTSNAIVTESRMDIMEGLYTEI

SEQ ID NO: 779229 - protein, 152 aa, Homo sapiens
WVFLGVTTSTASPRAESEGTCTWAASRVHTQAPHHGALLHSREHIRRVHREAHFHACDNTHISMWTRTAAHTNTSRVPPLLSTPTPAMYLHCCARHQPCTYTAVPDTSCVTALLPTAAPAMYPHCCAQQRKLCTRTAAHTSRVPPLLSTPTP

SEQ ID NO: 779230 - protein, 400 aa, Homo sapiens
MVNTRKSSLRLLGSKSPGPGPGPGAGAEPGATGGSSHFISSRTRSSKTRAASCPAAKAGGSGGAGVTLDEARKVEVDGSLSDSHVSPPAKRTLKQPDSVCKDKSKSRSTGQREEWNLSTGQARLTSQPGATLPNGHSGLSLRSHPLRGEKKGDGDLSCINGDMEVRKSCRSRKNRFESVNQSLLFDQLVNSTAEAVLQEMDNINIRRNRRSGEVERLRMWTDTEFENMDMYSRVKRRRKSLRRNSYGIQNHHEVSTEGEEEESQEEDGDIEVEEAEGEENDRPYNLRQRKTVDRYQAPPIVPAHQKKRENTLFDIHRSPARRSHIRRKKHAIHSSDTTSSDEERFERRKSKSMARARNRCLPMNFRAEDLASGILRERVKVGASLADVDPMNIDKSVSFV

SEQ ID NO: 779231 - protein, 414 aa, Homo sapiens
MVNTRKSSLRLLGSKSPGPGPGPGAGAEPGATGGSSHFISSRTRSSKTRAASCPAAKAGGSGGAGVTLDEARKVEVDGSLSDSHVSPPAKRTLKQPDSVCKDKSKSRSTGQREEWNLSTGQARLTSQPGATLPNGHSGLSLRSHPLRGEKKGDGDLSCINGDMEVRKSCRSRKNRFESVNQSLLFDQLVNSTAEAVLQEMDNINIRRNRRSGEVERLRMWTDTEFENMDMYSRVKRRRKSLRRNSYGIQNHHEVSTEGEEEARTSKLLPLEKISIESQEEDGDIEVEEAEGEENDRPYNLRQRKTVDRYQAPPIVPAHQKKRENTLFDIHRSPARRSHIRRKKHAIHSSDTTSSDEERFERRKSKSMARARNRCLPMNFRAEDLASGILRERVKVGASLADVDPMNIDKSVSFV

SEQ ID NO: 779232 - protein, 116 aa, Homo sapiens
APILPSLRKLPPQALPVFVFQSQPAFLAFLDLPRLQSLKAPVPPAFNTPHLHHPPCPAALLGFPRSCLPWLPPTQPRPCQIPLLDICLAQGTLPSKSLAQLSLYIYLRHSLIKVSI

SEQ ID NO: 779233 - protein, 108 aa, Homo sapiens
LAPCTVARGEARQEDCLKSGVQDWPGQYSENLSLQGQWGGAAGNNTHHHQTFRKQRNRDTTVRQPSPSMCSPEEVPLPGCSHLALCCWPAGEALVHAWIASWQSTHGT

SEQ ID NO: 779234 - protein, 100 aa, Homo sapiens
GELRDKQGGYSRDSNAQRGRGRGRAWSSQTLQPGHQWKLGALGACLSQLERKGEKVQPPLSHAQASHGWNLEVWEIPLAGVCPHKTWQRRERTSVESQDN

SEQ ID NO: 779235 - protein, 105 aa, Homo sapiens
ICLMTFFPLHTKFSFSPHKSSCIHSQPFLGFRWSVPEAIPGHRESERVLTVSRADVPLVVARTPRKIRKHHHNQESGGQLPSPAGPLGDTRYRAQARKVSLVKSQ

SEQ ID NO: 779236 - protein, 51 aa, Homo sapiens
MSVRFSSTSRRLGSCGGTGSVRLSSGGAGFGAGNTCGVPGIGSGFSCAFGG

SEQ ID NO: 779237 - protein, 108 aa, Homo sapiens
MSEAKDNGSRDEVLVPHKNCRKNTTVPGKKGEEKSLAPVFAEKLISPSRRGAKLKDRESHQENEDRNSELDQDEEDKESFCRGFPMSGCELETSCCVCHSTALGERFC

SEQ ID NO: 779238 - protein, 113 aa, Homo sapiens
MGSPFYCNGGYWLQRTECWRTMNEFHFRSAQLAVPGRQPQELFRRHRATSAWSSRRRSALVVGTIGPGHGRLQDPSCTKLPSPPAWFPFFMNRSMGHSQVGMHVFHRMGTTSS

SEQ ID NO: 779239 - protein, 34 aa, Homo sapiens
KGEYVLMGFNEQTVKCLDILSSHHSSLSVDEGAM

SEQ ID NO: 779240 - protein, 96 aa, Homo sapiens
YSCELEFVQRNGIAIPFQRTVNSVRDSENMKQELLTRKEHSGDQTSARASGEVTYASLFFPSCPRPSSPAMKRVLNLCPVEVPFGSQLEARAPFFK

SEQ ID NO: 779241 - protein, 146 aa, Homo sapiens
YCRCGVCGSLVDAGYCRCGARGSLVDAGYCRCGVCGSLVDAGYCHCGARGSLVDAGYCRCGARGSLVGADSIPDPRGSRLSGATAYRKVDNHRCGMFPLHCPPPAVSPPLPLWRHQARMQECCCESSFKTVKTSIKSSYSKPSVSY

SEQ ID NO: 779242 - protein, 408 aa, Homo sapiens
GGSGQAHAPSIATPGLWDAPPDRFRLAEPVGPGAAAAVLRPCAAGWGGLRCAEALVSAMIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 779243 - protein, 270 aa, Homo sapiens
GGSGQAHAPSIATPGLWDAPPDRFRLAEPVGPGAAAAVLRPCAAGWGGLRCAEALVSAMIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFTHDTLFSESEAKRSSA

SEQ ID NO: 779244 - protein, 448 aa, Homo sapiens
GGSGQAHAPSIATPGLWDAPPDRFRLAEPVGPGAAAAVLRPCAAGWGGLRCAEALVSAMIRQERSTSYQELSEELVQVVENSELADEQDKETVRVQGPGILPGWRDQATLSLLEARCQAKSFRGLGCVKHQLWKKRKSSRGNGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 779245 - protein, 172 aa, Homo sapiens
MAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQRQVWLTTLTRGQLPKKVLNCFLWSLNGKILSSRKSKI

SEQ ID NO: 779246 - protein, 408 aa, Homo sapiens; identical to SEQ ID NO: 779242

SEQ ID NO: 779247 - protein, 307 aa, Homo sapiens
GGSGQAHAPSIATPGLWDAPPDRFRLAEPVGPGAAAAVLRPCAAGWGGLRCAEALVSAMIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQRQVWLTTLTRGQLPKKVLNCFLWSLNGKILSSRKSKI

SEQ ID NO: 779248 - protein, 318 aa, Homo sapiens
ALLFLFPWKLLAGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 779249 - protein, 142 aa, Homo sapiens
VPSSTETLTGFMQACESAYSSWMYSARTQHLELDLTTQFHGESLTEALWIPARRQLVTHIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 779250 - protein, 110 aa, Homo sapiens
LQLQDKSLILYYVLEWLPLPLFVMALEDPLQPQDPVVVVLPSCPLSSRSPLLTLTLRLSTGTSRAYCSRNAVLQAYSGPEQLTSSSTPPFSLSLLPINMEGYVKLRALVH

SEQ ID NO: 779251 - protein, 69 aa, Homo sapiens
IAAPREARTNHAVTPRSRGRAFVHSLIHSPPPTLPERARSPRCGQVLPDVVFANALSCATAGMVGAGGP

SEQ ID NO: 779252 - protein, 108 aa, Homo sapiens
PCIHPSIHLPTHPPKLIYPLNHPSTYPPLPPSIPLLPIFPLIPSNYPSIHPAVHPTIHPLTNLSTHPRMHPSIHPSTHPFTHPPIHPLTCLSIHPPSPWLFHVFLQPA

SEQ ID NO: 779253 - protein, 103 aa, Homo sapiens
PCIHPSIHLPTHPPKLIYPLNHPSTYPPLPPSIPLLPIFPLIPSNYPSIHPAVHPTIHPLTNLSTHEWRGEQGKADSNRNVVRPIREGQEKKNPYNRSAVKKT

SEQ ID NO: 779254 - protein, 131 aa, Homo sapiens
RYPVFIDATSVTKLKCISFKGEVTLVVDERVPDRGSRRYGPWSIVPIPSSNEEIRLVDDAFGKICHMVSDGSWVVHVQAAKLLGSMEQVSSHFLEQTLDKKLMSDLRRKRTAHERAKELYSSGEFSSGRKW

SEQ ID NO: 779255 - protein, 109 aa, Homo sapiens
SARTPLMPWAGGPKGQAGRPMWAAAPGPDTQLADTQHWPAAAETHGGRLTHNTRTGTLTRGTGMLAHTLATASTRSSHAGARRHTRLGQHILADSLVGMHSSHSNTHQF

SEQ ID NO: 779256 - protein, 56 aa, Homo sapiens
QGFPEIAIHVFLQPWLSPCVYKYISLLSAPVRPLSHTKAAIPPPPAHPRFAMMQPG

SEQ ID NO: 779257 - protein, 48 aa, Homo sapiens
MRKGTLPTYELTFLTLCHLVMTAQEHKPGAAASGRWLRHVKVEGCCTL

SEQ ID NO: 779258 - protein, 78 aa, Homo sapiens
SLFIGHLDTAARNNGIGPLSPAWCLIGCWGSGCAKLDGTFETQPPTSFLRRGDRSPDTQGFGYSHRERGLPHGADEYL

SEQ ID NO: 779259 - protein, 45 aa, Homo sapiens
DAWIDARMDGWMDGWIIGWMDNWMDEWTGGCMDGWMDGQVDAWVD

SEQ ID NO: 779260 - protein, 115 aa, Homo sapiens
MYGDIFNATGGPEAAVGSALAPGATVKAEGALPLELATARGMRDGAATKPDLPTYLAALLPAAALGWRSSSSSSVASCAIRPSPRCPRPLAARRPRALEDAAGVLGTEPRPPGAP

SEQ ID NO: 779261 - protein, 94 aa, Homo sapiens
MFMSPFRTAPRYAVLAWWGSLCRFRGATCHTHSAAYSHMATSSCGNTASVVFGRVTTYPAMTVDKENCHSCSESLQLVFCAPRGPAFTPSAVTG

SEQ ID NO: 779262 - protein, 106 aa, Homo sapiens [sequence omitted]

SEQ ID NO: 779263 - protein, 200 aa, Homo sapiens
GDWLSLLVFIFLPCWMLPALEHWTASSLAFGRLDLHQWFARGSQTFCHRLKAALSASLLLRFGTRTGFLAPQLAGGLLWDFTLWIMVIMEANVRRAKQRRTLSHLRKNLEKSPGYIFVNKWCPRTDFQLNSTRGDKVGLVSLILKLFQKIEKEALLPNSFYEASIILIPKPDQGTTKKENFKPISLMYIGTKILNKILAN

SEQ ID NO: 779264 - protein, 144 aa, Homo sapiens
MERASGLSPGGGLGATSRQMSPGTQLANPPDHGDKDCLGRISPGSGKQIQAAGQLPGPPTSLAPAQGRLRSLTPWGLQTPEHSEPEGIGHLQAATEAVLPHSTQNLITKRNLMVQARVQWRDLGSLKPPPPRFKQFSCFSLPSS

SEQ ID NO: 779265 - protein, 112 aa, Homo sapiens
FIKVVKNKAYFKRYQVKFRRRREGKTGYYPQKCLVIQDKNKYNTPKYKMIVRVTNRDIICQTAYARIEGDIVCAAYAHKLPKCGVKVGLTNYAATYCTGLLLARRLPNRFGM

SEQ ID NO: 779266 - protein, 89 aa, Homo sapiens
HKRYPLDRIKSAHKRSRTQQDPCADTLRHSETRKDAHLREQGSRRGSQLQKARPRALGDAQPTDRGSNTKGGHLQGRERPRSRQGARTP

SEQ ID NO: 779267 - protein, 144 aa, Homo sapiens
EKGSHSVNQAGVQRCHDGSTAASTSWAQLIFPSSREWSHVPPCPATFCIFFIEMGFHHVAQAGGQLLSSSYLPTSAFQSAGITGMSHCTWPWTVFLMPQKVTSRIEMFLCRLGTVAHTLSSQHFGRLRQADHEVRRSRPSWLTW

SEQ ID NO: 779268 - protein, 105 aa, Homo sapiens
KEKKAGAPAPGAVRWLGFLRRDWLAEGRNYSANMTIISCLATAHQSRETTQVGNPVCASSASGQPLRAPTFSHAILPLRNAPPPFSLIPFLFNSVFFLWDAFART

SEQ ID NO: 779269 - protein, 138 aa, Homo sapiens
GPKREERGGASARAPGSSAVSGAPFPSPGPFGAFTREDVGQDFALWRRLTSAALAHCEIRHGQRGPREPGTLPVGYGSAATAAPWAMVSLPPTPLPLELRASEAAARGHGWRGSAGLGQSPGFRLVGVGCGLCYPAPS

SEQ ID NO: 779270 - protein, 47 aa, Homo sapiens
MCPGVDSRAWVLPCRIWGGGIWGWLPSCGGCRQPPQDEEIETVLRGL

SEQ ID NO: 779271 - protein, 136 aa, Homo sapiens [sequence omitted]

SEQ ID NO: 779272 - protein, 135 aa, Homo sapiens
MVGQTEDDTAQQLVPTCGMKGVGERIVEYVSNIPALQRATPKGLASVSPDLEHRQEWTYSKSPLMGKGTRLEASENKRAGWLAAAPENLKYHRQIAQGAKDYEILKKETNKFILRIYTHWSHIPTLLSPQGEAKS

SEQ ID NO: 779273 - protein, 116 aa, Homo sapiens
PSSYPGCRGRGCARAASSGADLDLQSAFAAPASCVSKACTGPASASASQRTLHAQLALASLRPPQSKAPAFRPLRQVQLLPASGLFRPSSFLTSAIPGPVFPFRQPLGLVAQDKFD

SEQ ID NO: 779274 - protein, 280 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITGVSLALPS

SEQ ID NO: 779275 - protein, 72 aa, Homo sapiens
RTLCIMLLLLQDGRMVVSVIQDCFSYIFSAFFNAVELKPAYVFLCAYLLGSTMMSTTEAVPPLKTQDPLYFF

SEQ ID NO: 779276 - protein, 67 aa, Homo sapiens
NVQRHWRDWWWKVLATTSEPLAGDRMKLVGDESCILLTCRSSCRPAGQTAKGRQQQQWKARSGHCPI

SEQ ID NO: 779277 - protein, 119 aa, Homo sapiens
MCRGHQGEYLQALFPFLHETASFGLGHWALGPPWSSRIATSQNPFSIRHMKVTVTRNGSLDNQPIQNTDLDIGRPRVQILPCSLSAGKLWSNYLASPSQFSLLQNEVTQAATSQNECEN

SEQ ID NO: 779278 - protein, 119 aa, Homo sapiens; identical to SEQ ID NO: 779277

SEQ ID NO: 779279 - protein, 119 aa, Homo sapiens; identical to SEQ ID NO: 779277

SEQ ID NO: 779280 - protein, 119 aa, Homo sapiens; identical to SEQ ID NO: 779277

SEQ ID NO: 779281 - protein, 144 aa, Homo sapiens
DPICNSRHLTNTSGAGKDHSMTQLRPIHLSRNPPPLPAILSSLQREPLCFLRCLGLGRGCPSVRLAYSYRFPNSTQLHQASLGWVPGPLSLAPLAVCCQSLSWHPDRCLRPPKTTHTKPKTTHTTPIMLTCIQQLGTYFSVLFL

SEQ ID NO: 779282 - protein, 122 aa, Homo sapiens
DLLSGLSQPQGPPGSNRLIPSLLTKETVWDNSRTLFHLFHSHVEDRSLNEGTKSLMYLSPRLLKDSHHPCYHTFLTPDCTTACWPPLSALHDMSQGKVATEDFTQFWELELAGAPPLCQWLF

SEQ ID NO: 779283 - protein, 55 aa, Homo sapiens
MLDGGQSPQYTLDFGDLQYKGWLKEHSETQAANPKLYMTNNRQGMRTQEKRQMAK

SEQ ID NO: 779284 - protein, 40 aa, Homo sapiens
MWCNKPNAQLNLTTAKKFRRFSHNRKYPHCSYMMEHYFYV

SEQ ID NO: 779285 - protein, 405 aa, Homo sapiens
HSKEETGSHSPVCLQLHYKHSENRGPQGNQARLSSVPHKAELQIKLNPVCCELDISIVDRLNSLLQPQKLATVEMMASHMYTSYNKHISLHKAFTEVFLDDSHSPANCRISVQVATPALNLSVRFPIPDLRSDQERGPWFKKSLQKEILYLAFTDLEFKTEFIGGSTPEQIKLELTFRELIGSFQEEKGDPSIKFFHVSSGVDGDTTSSDDFDWPRIVLKINPPAMHSILERIAAEEEEENDGHYQEEEEGGAHSLKDVCDLRRPAPSPFSSRRVMFENEQMVMPGDPVEMTEFQDKAISNSHYVLELTLPNIYVTLPNKSFYEKLYNRIFNDLLLWEPTAPSPVETFENISYGIGLSVASQLINTFNKDSFSAFKSAVHYDEESGSEEETLQYFSTVDPNYRSR

SEQ ID NO: 779286 - protein, 101 aa, Homo sapiens
WLRSCASVSSPYGLAPNPVMQRDLPRCRRHFHVRLGKSDFSTNHWLPPAMSPRLELWGPPSSLNTQNLCQLSQDPSCGGLGVEGCRDPKTQPGARFYTGLD

SEQ ID NO: 779287 - protein, 256 aa, Homo sapiens
MPTMWTPAVVTVLRSPMVLLQVWSLPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGH

SEQ ID NO: 779288 - protein, 78 aa, Homo sapiens
CAWAGLDEGISSTLFVIITVALGVGVITIALYLSYRPCKVDRRKLLYRQKEEDKEEESQFAVQEEKSTTHIIDNCLIE

SEQ ID NO: 779289 - protein, 47 aa, Homo sapiens
SCPQASPSHASHTAPHGCHSSCHLQMALSQNTKRPPALRVEKPSSNP

SEQ ID NO: 779290 - protein, 291 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCQPASGGARAGSGKEGGPMGLGPFGYGG

SEQ ID NO: 779291 - protein, 220 aa, Homo sapiens
VSEAALLPGPKDSQLPPLPSRTNNPPKVVMLFFTQCFGAVLDLIHLRFQHYKAKRVFSAAGQLVCVVNPTHNLKYVSSRRAVTQSAPEQGSFHPHHLSHHHCHHRHHHHLRHHAHPHHLHHQEAGLHANPVTPCLCMCPLFSCQWEGRLEVVVPHLRQIHRVDILQGAEIVFLATDMHLPAPADWIIMHSCLGHHFLLVLRKQERHEGHPQFFATMMLIG

SEQ ID NO: 779292 - protein, 74 aa, Homo sapiens
MLCHPSSWRELPPVERVCPSLGTRALLFLGIYHILFQVPFTHPAGWEEYIIVPLEVPPCVGHFSRSPGNTGIFL

SEQ ID NO: 779293 - protein, 49 aa, Homo sapiens
MSNASGPFNASGPFNASGPFNASAIQRLRAFNASGPFNASGPFNASGHS

SEQ ID NO: 779294 - protein, 180 aa, Homo sapiens
RCSAQETAVRARARPSRSGTGVGAPSGCARLRAPAQQPEQRPPPARRGCPDAGHTGLGPTDGNRSGGAAPPLLPPRRSQSRSCCAARSRGHSNRRQVPPPLAPAINTGGREGGADTRRAAIRRLTGLSRSGAALVSSACRGLRWRVDSETEGRVWDDLTKLLCILLQADREKRPTTEEPS

SEQ ID NO: 779295 - protein, 84 aa, Homo sapiens
VSTITITITITIIHHHTITITITIITNTITITTTIITIFTITVIIITITVIIVTITIITITVIVITIIICTATMETGPWKSNTP

SEQ ID NO: 779296 - protein, 59 aa, Homo sapiens
MGLKNKKNTEDPEEPLIASQSTEPEIGHLSPSKKETIMVTLHGATNLPACKDGSEPWPY

SEQ ID NO: 779297 - protein, 34 aa, Homo sapiens
LRLKPRPLPGGSRGPRLQAPTPARLHKASSGPGP

SEQ ID NO: 779298 - protein, 81 aa, Homo sapiens
LQLLSDVWDHVGPPTLHQQQQAQPLAQLLSGPLSCKLHEDRDWLHQHCQARCARALNIQQMCLGSKNIHSSSTVTAKSKKH

SEQ ID NO: 779299 - protein, 122 aa, Homo sapiens [sequence omitted]

SEQ ID NO: 779300 - protein, 116 aa, Homo sapiens
MKLRLKKEKFAKGGNSMELSVHRSPGPRIPPLILKTQEGFCIPTMKQVWGWICRVATQSMQNRRSMDFSILAIPFTSWAILSKLPPNVPQFPHLQNGLVAGIVPSSMRPEVMGRGW

SEQ ID NO: 779301 - protein, 114 aa, Homo sapiens
KPHLHQKNTKTSQAWRHAPAIAGTRQAEAGESGREVAVSRDGSSTVQLWLGMRGRPWKGEERGERGFCIFCRDGFHHIGQASLELLTSSDPPSSAFQSAGIIGMSHRAQPIISS

SEQ ID NO: 779302 - protein, 111 aa, Homo sapiens
LSKNDKGGRHRLEGSVRKKTEDVAWETTVPSSATAAAFIIYCCLMSSVCSNRCCNGMNSFICFLCVICTYPVGAKDIGVRWYEFQCWPTSFTGWVTQSMFLNPFEPQFPHL

SEQ ID NO: 779303 - protein, 95 aa, Homo sapiens
MDGPPKPPGRCSQKWAGVGGGCESHTEEGLREPQTRSNPSSEGAWPAGGQIQQRRSLGRWLDRTKARPAHWTAVEFPRTPRRPSNCGVSAHGRGL

SEQ ID NO: 779304 - protein, 69 aa, Homo sapiens
GRRPADITLGDSVYYWAMSMLHPSRKENQILNSCICPITSSTRHQVPRGQISPAVATAISSNAWTVPST

SEQ ID NO: 779305 - protein, 106 aa, Homo sapiens
MVTDYLIFVLWLCPLNPQHLAYVQLLVDIHTEPQHLLFPLPGMPFSRTPSQRAALFLPASHHPNGTITQILPSLPCLWALSSPCPAVFFSLPCSCHCLTCYQRSRV

SEQ ID NO: 779306 - protein, 140 aa, Homo sapiens
LQPQEPGFIDQKRHMRLWPAALLPDAGQGERRGREAGGKTPTLSVYRGSHILCSAPPGPWEGVLPTPHLWPLTSTCTCLFLSDCDYLKGSRQGGFMAWCLQVKATPLPSPLLLGPGADVSESASLCSLCRADSDFRNALL

SEQ ID NO: 779307 - protein, 171 aa, Homo sapiens
MQAPGPTLYALRRTAKVWLSLRQGRLECDRSPTLGPAFACACKSTGVEAPEPCASSRPQHPRHDTHAHARVHTARHAHALSRADWYPGVAVRTHTHMHTATSVYSRSPVGTHKQNSHSRSRPHVPRRVPGGIRAPSTFPPENPARSRGQLWGGVRRGLARGPRVTSPGGCA

SEQ ID NO: 779308 - protein, 202 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGG

SEQ ID NO: 779309 - protein, 232 aa, Homo sapiens
AGRSFGARALGGGSKLTSWIFSCFSLVFDFFWTLVSTISEMPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLETPVDIVNSWTQTMTNLAKQVHGGS

SEQ ID NO: 779310 - protein, 131 aa, Homo sapiens
MDESHLPQLPPGVCMAELGLPREPRPQDPGTAPAPTLAISPHPSLDSARLGSPRPWHPVQAWRHLLSFLQGDSDSPCLPGWSLDSGGHRVLEQHQHLLLSPGVDARIMKFMPGKAWRPRPPPLPRICVKHK

SEQ ID NO: 779311 - protein, 137 aa, Homo sapiens
MINQRSAPNKKPRRRAIPIKIISTVGSSTLYSQYVRHPPFFFRDKRVPPNKTRMIINITNQQAPPGARFIQQHQSRLVVADNNTLAPQVREVTLRSGEPLTTCWWCARHKHLSRDDDNHNSPRHENLNGKTPTWTSK

SEQ ID NO: 779312 - protein, 118 aa, Homo sapiens
MTLIPLPNPNYTLQPTGKGSEMNCRLGNQHPHPPATGRAASAGDTHPRPCTPPPPSQATQTAAWGNLGGPVPSLCRHPHEPRHRLPPSLSRKSHRVVAGIVWWPGRLTLALTRRPSRC

SEQ ID NO: 779313 - protein, 94 aa, Homo sapiens
AQGAQESIKAMWRVPGTTRRPVTGESPGMHRPEAMLLLLTLALLGGPTWAGKMYGPGGGKYFSTTEDYDHEITGLRVSVGLLLVKRFLEGVIYE

SEQ ID NO: 779314 - protein, 206 aa, Homo sapiens
AQGAQESIKAMWRVPGTTRRPVTGESPGMHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 779315 - protein, 135 aa, Homo sapiens
MDKENVVHILHATLCSHKDHVLCRDMGEAGSHHPQQTNTGTENQMPHILTRKCKLNNENPWTQRGKHTPGPAGGRDEGRELRGRVNRCSKPPWHTYIYITNPHVLHMYPIFFLCVRKKKKIHKQLQALSPETVTF

SEQ ID NO: 779316 - protein, 99 aa, Homo sapiens
PLVPKKYVDTTGTWTNDGHVKRDEVHGPEGHLDHGLHEEGLEPNWADLERIPLDLIPELEGRDGRRRVLGSMFLAEEAHCKSKGTEEAWWSLENWDSSS

SEQ ID NO: 779317 - protein, 86 aa, Homo sapiens
TPHRVYWGLGVSTCHGAPTLVPSSQDSLVWTQLWREDSLALGSSCRNMAFFCSCGSRAVETSWVFLLILCQPPGAVCTGVGHLAPF

SEQ ID NO: 779318 - protein, 55 aa, Homo sapiens
GSQVTDGKAWATVGDWVPSWQEPTGTQSLPVILPCWLQAQDHRPEAMRDQGRTRA

SEQ ID NO: 779319 - protein, 83 aa, Homo sapiens
VGVHLLAEESQVLQLISVEIARNVDALTAYDHHLPAQHYLLSHDGRQAAQEMASTMEDWDLHLRHLRQPPGKAHLFIVLIVNR

SEQ ID NO: 779320 - protein, 83 aa, Homo sapiens
APRQEEGEQRDLLVGPYPPQPLLLASLFRLFPSALTYDRERARNSRSEKAEDERWPGQERREQSCRHWRARSRQGRQAAPEVA

SEQ ID NO: 779321 - protein, 128 aa, Homo sapiens
GSDAAVDLRIPVFIDAFCRALRKSIRRWPALQPQPGLGAGPGHHFTRDAFNTVGELFANQPSQELDPVMDLLVLSLGHQVIILDIIHIHKEALTKVMESRQHVAEGKTEMQRLMTSESQEQDFFGHCG

SEQ ID NO: 779322 - protein, 119 aa, Homo sapiens
RAGAPAGRSVAKRSVLGLGPEAPSRPRYGARRSGPAGRLDGTSGGFRFFSSPCALLGGSTGRIFQCPDRLKCGQAEFIHYSASTWGSPWPGALLGSAHPVKKDGALFSRRIHFSRGVFA

SEQ ID NO: 779323 - protein, 67 aa, Homo sapiens
MLKTGMWQREPTLLVTGLAPAAGESMSRAEGDTVSITGELPFEGDTGLSSRRDPGHVDAAANLVVVG

SEQ ID NO: 779324 - protein, 69 aa, Homo sapiens
GELRGHVGPPCAGLSGFLGHCGLLQVSLLPFSLASAWPLVRLCTSWGLYGIGHHLIAEPGLVVLERRRK

SEQ ID NO: 779325 - protein, 140 aa, Homo sapiens
PPFSQSRLYAPQDTGYLFSLCNSTITHLKIYGPIQHIQHYFSQFLSIKPQKCLFHALWYSLPLSIFQDLPIVWNILHPFHLNPESASRFRNSTSSVLQLFQPTLLTLYPKLLQNLECISLCMWQLIIFVVSFKFYLPNYT

SEQ ID NO: 779326 - protein, 232 aa, Homo sapiens
MHSHTTHPHTHMCHTTLNSHHTCTYPHTHRHTPHRTCTHHRGTHTQPITYAHTRTIYMHIHRFIHHTSQYTTPHRHLCTICAHTLTPHMHTKHHIHTRTICALRTYTPHITLHTPHHIRTHVHSCADTIQIQVHTYTTHTLYHVLCHTHKPYMHTHKYHTIPLTLYMYTCTQTHHTTNTRTPPHTDTYHPTYTIHVHTYPTHAHIHTASQNTTYSCAHTVPRCYNALYHGAK

SEQ ID NO: 779327 - protein, 151 aa, Homo sapiens
YIGVVFKAICGNFAKEIVLSYALQFSLHLLPSFMANRVNIFFCEEPDSKHARLCKPYSLYSVFVVWKRLIHKPGVLKQGPFRFSYLHPSRHLAMSRVIFGFQYEGWVLLASGEQRPGILLSVLQCIVQLPPPPKKSLIQNVSSSEVEKFYL

SEQ ID NO: 779328 - protein, 61 aa, Homo sapiens
MSYGYLGEEPSCSGNSKCKNLEMGLCFPMFRKSQCDWRRVNQQGEEMKSKKLAGEDLVIGP

SEQ ID NO: 779329 - protein, 121 aa, Homo sapiens
RRAASAAAVAVAAAAAGIAAAAAAARPASSPAAAPPPSLAGALASSLDGVRAARELDTLRTRPKATERRCSVVPGGGRGGREGKRRGGGEAKTPKNKKRETTPNNWGGGKKERKETHPPTK

SEQ ID NO: 779330 - protein, 173 aa, Homo sapiens
MGGLKRDIILSPGNQFAFLPPACSILHQEGPCDMWTPKLALCLSLSFSLSLSLSLTYRHTHTQSYPLNNPRAEIAQPVAMTAFRKMASRIHANCRYQFRAFWTANVGSHITKSWSKNEKRVRLEGPKVTSPHRHGSDQRRMTAEYHLRPRTEASCVHILGLYFSCRAEKNWRK

SEQ ID NO: 779331 - protein, 68 aa, Homo sapiens
VKAGDCANEDVTEFQIAWISRKSTGSPSEGFCGETDGPPGRRALVWALFSCWSQYKDGNQAGHGGSRL

SEQ ID NO: 779332 - protein, 125 aa, Homo sapiens
ALSVGYGRCRSWLPSLLPCKQELSLRAGEDLHYSFCTGRPWVISGEFQQGGFCGHEPACILPPYVAVSPNPWQLTQLACICVGEFCFPLPHQCEGVQSDPLHPPTAIAGRALADTASLLQPAACP

SEQ ID NO: 779333 - protein, 128 aa, Homo sapiens
VPLCSCSCPNLPSLQMPAVGMGRCSLWQLPRVAGAMPRLCFLGPRPCSSETAPFLGPRLCPGSQGLVASCRPHPASRRHPASAFLGFLLERPTPPLPSREMPRMALAPGCLPQNRHPPRAALICHPQA

SEQ ID NO: 779334 - protein, 133 aa, Homo sapiens
DLSSLQTSTSHVQATLLPSASRAAGTTDVCHRAQVIFVFSAETGFHHVAQAGLELLSSGDLLTSASQSAGITGMSYRAQPKCRHSFYNPLLHESWGSAVTGPAVTRCVTSLMVSMDNIIIVQPKIGLPKYFLY

SEQ ID NO: 779335 - protein, 32 aa, Homo sapiens
MGIGGSPLPATPHSAQTLLRSGGRRTSTQWPE

SEQ ID NO: 779336 - protein, 35 aa, Homo sapiens
MAKWGQGNPHWIVEEREDGTNVNNWRWRGWRRPPS

SEQ ID NO: 779337 - protein, 126 aa, Homo sapiens
GVSLPAERPLVHSVLAWGPFLALWAHLELLGTGTTGRVTLHCPEPPAPHQALLASPRAPGHSRGQSGHPGIARPGPVQGLWHLGEAFAPLSSEQKGWQRGKGTGQFCTWPFSRMKASTSRPSPQKE

SEQ ID NO: 779338 - protein, 34 aa, Homo sapiens
SKRVRDNLPFWLFVHCLGPRDWIMPAHTGEVRSL

SEQ ID NO: 779339 - protein, 71 aa, Homo sapiens
TDTSCSPHPPYGVTWARLADKSKTVQETLSDRGVQFPTQTPACSVRQTGRGRTQPLRMSVYYFPVGALRSL

SEQ ID NO: 779340 - protein, 329 aa, Homo sapiens
MMSNSSSEIDVIKTRIPTYDEDDNTILYAYETKPEFVNKEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 779341 - protein, 208 aa, Homo sapiens
MKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 779342 - protein, 189 aa, Homo sapiens
MTVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 779343 - protein, 208 aa, Homo sapiens; identical to SEQ ID NO: 779341

SEQ ID NO: 779344 - protein, 208 aa, Homo sapiens; identical to SEQ ID NO: 779341

SEQ ID NO: 779345 - protein, 301 aa, Homo sapiens
MMSNSSSEIDVEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 779346 - protein, 190 aa, Homo sapiens
MKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLEIDGKALLLLTSDVLLKHLGVKLGTAVKLCYYIDRLKQGKCFEN

SEQ ID NO: 779347 - protein, 208 aa, Homo sapiens; identical to SEQ ID NO: 779341

SEQ ID NO: 779348 - protein, 301 aa, Homo sapiens; identical to SEQ ID NO: 779345

SEQ ID NO: 779349 - protein, 110 aa, Homo sapiens
SSGSSHSPSLSSHYSDSRSPSRLSPKHRDEGRKTGSQRSSGSRSPSPSGGSGWGSPQRNGGSGQRSGAHGGRPGSAHSPPDVRTLRFAEGSRAAGCAVRGRAGRQRGRGR

SEQ ID NO: 779350 - protein, 55 aa, Homo sapiens
RLLWGRPSEAESDIQKEVNHVLFMMNEANITRITSPQISLHSSETKTMASSPPLS

SEQ ID NO: 779351 - protein, 99 aa, Homo sapiens
MPGTGSIQMSAFSRPTTDYSIAKGGYTHTHTHTHTRTHSYFLKQMSFFCFFRESHTVTQSPRVECRSGVTAQCKLKVGGTTSPPAVSSCSAEITSMSHH

SEQ ID NO: 779352 - protein, 112 aa, Homo sapiens
ERTITLRRMTLQSSLWAEAGARLDLKPYPCMAPPPSCVPLLVNHMHPNPRLRLLSREPGPRPACMGDIVKTLRFTDRESEAQKGHTVCKWLCCTAPLRWSPSPSPCWSSCPG

SEQ ID NO: 779353 - protein, 74 aa, Homo sapiens
PISPALQLGQSSLVLGHRSIRMQGASRLPNSTIYVVEPGYLGFTVHPGDRWVLETGRLYEITIEVFDKFSNKVY

SEQ ID NO: 779354 - protein, 68 aa, Homo sapiens [sequence omitted]

SEQ ID NO: 779355 - protein, 434 aa, Homo sapiens
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 779356 - protein, 101 aa, Homo sapiens
PSFRSFNSKRHLIEMGYLQGGKMAYYEMRAEHSVDIDVDIDWPIAEQRVLRYGYFGKEKLKEIKLLVCNIDGCLTNGHIYVSGDQKEIISYDVKDAIELLN

SEQ ID NO: 779357 - protein, 263 aa, Homo sapiens
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLR

SEQ ID NO: 779358 - protein, 261 aa, Homo sapiens
MDSTQVGVFKKANQIGLTCLLQSTDSCALEAQICFCYGNLNGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 779359 - protein, 222 aa, Homo sapiens
PSFRSFNSKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 779360 - protein, 434 aa, Homo sapiens; identical to SEQ ID NO: 779355

SEQ ID NO: 779361 - protein, 434 aa, Homo sapiens; identical to SEQ ID NO: 779355

SEQ ID NO: 779362 - protein, 434 aa, Homo sapiens; identical to SEQ ID NO: 779355

SEQ ID NO: 779363 - protein, 371 aa, Homo sapiens
KVEEIGHYYKKKYIICLWSAVVDTVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 779364 - protein, 234 aa, Homo sapiens
IVSVSVSPKNPAGLSVGIAIETSKTRVLEDFGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 779365 - protein, 153 aa, Homo sapiens
RTLSTWRGSRSLAGSCVRPWIQGPSRGAHVREWAARPGRGSGEGVGLLEGLGPPGPPLLEGGHLSCQGCARSGVPGAGLRAQEEGLQLLPCSVAANGHNLGQFLSPPLRIIRKRGDYTSPTVPSSRVDLTGKSKGGHPGATSVIICELLWMGA

SEQ ID NO: 779366 - protein, 128 aa, Homo sapiens
MDLSSEAAGFVRAGSAARPRHSHPAIQQLTSLHCLLASGREDLQDPLGLSLSSFAMPLLDGDLEGSGKHSSRKVDSPFGPGSPSKGFFSRGPQPRPSSPMSAPVRPKTSPGSPKTVFPFSYQESRQLP

SEQ ID NO: 779367 - protein, 114 aa, Homo sapiens
MNSIRISFFGGILSMFTYEIISANTDNFISFFPSWMPFISFSCLIALAKTSSTMLNRSSESGHPCHVLDLRRKSLSVSPLSMIFAVGFSYVAFIMVRYFPCISSSLSVFILKGC

SEQ ID NO: 779368 - protein, 117 aa, Homo sapiens
SRVGSCARCFCRVTLRSLVFSCARLVLRVSALSPRGFRSVLVSHVPRPWLVEARSAGFFCGTQPISSAVVWNVWPVSLRWAPAQRLLLTFWGAGARTHSFVVFCFFFVAQRSFIVFL

SEQ ID NO: 779369 - protein, 117 aa, Homo sapiens; identical to SEQ ID NO: 779368

SEQ ID NO: 779370 - protein, 113 aa, Homo sapiens
MLGNIVDSSSFAMVTLVGHSFLNSTHSLDVYNITFLIDSHICGQRNNSMFSKRPREHISGASPLSLCVRHFGELLEDGGSGRKGKEAGPARALQGPVGCPRRLPEGNANRKRL

SEQ ID NO: 779371 - protein, 85 aa, Homo sapiens
EDGYRMKFACYYPRVEYGFQVKVLREDSRAAFRLFETKITQVLHFTKDVKAAANQMRNFLVRASCRLRLEPGKEYLIMGLDGATY

SEQ ID NO: 779372 - protein, 106 aa, Homo sapiens
SGADRGTPRVLGAERDHACLSSSPAKHSKQDRSNRSPGMGPLPNADPQAPSNQSAALASAQLDESPQHATSPCPQRALALTFSPAYKARPHSSSLPAKPHLSFNTK

SEQ ID NO: 779373 - protein, 90 aa, Homo sapiens
ITTTEIPSHSTPSFTSSITTTETTSHSTPSFTSSIRTTETTSHSTPSFTSSIATETTSHSTPSFTSLITTSETSHSTPKGTCLVFEELVT

SEQ ID NO: 779374 - protein, 78 aa, Homo sapiens
PESSWGFSSLSICEDSGVKVGLNFCGGSIRGLVNSTKLFLHLWDPAGSDASSQIATRYPGKKSMTQKEPENPNSSKYW

SEQ ID NO: 779375 - protein, 777 aa, Homo sapiens
EAWGVNRPRSHHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 779376 - protein, 1113 aa, Homo sapiens [sequence omitted]

SEQ ID NO: 779377 - protein, 1188 aa, Homo sapiens [sequence omitted]

SEQ ID NO: 779378 - protein, 776 aa, Homo sapiens
QNENSPLLKDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 779379 - protein, 1188 aa, Homo sapiens [sequence omitted]

SEQ ID NO: 779380 - protein, 1135 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESNYDLT

SEQ ID NO: 779381 - protein, 1188 aa, Homo sapiens [sequence omitted]

SEQ ID NO: 779382 - protein, 1138 aa, Homo sapiens
MCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 779383 - protein, 822 aa, Homo sapiens
MANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 779384 - protein, 945 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTPITVHDSESDDEEDSLELQEVWIPKNGTRRYSEREEKTGESVQSRELSVSEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 779385 - protein, 49 aa, Homo sapiens
EILCPTKDPLRETSPLELRGSTRDGFGSLSLTLSGPSGWKEGLPQGDAF

SEQ ID NO: 779386 - protein, 84 aa, Homo sapiens
MRRDHLFWATRVGITASLRQQDTGIVGGKQLTFSFYSVDLACIFSFNPFHNPGKLLLSLFPFLLMKNMKLEEVKKVDQSCIFTL

SEQ ID NO: 779387 - protein, 59 aa, Homo sapiens
MQVQGEGDSSTPTLKAAGTRDEFVLTWSSSDLTRDKDRLSRPHSTLARPASLSIPSMHL

SEQ ID NO: 779388 - protein, 80 aa, Homo sapiens
IPLHPTITAMLPDTRRLKAVVAPEPGMRSVSRARSTRLSPRERIKKSCCQIEKSEEVQVLYLKKVTVTTENARFEAVAVI

SEQ ID NO: 779389 - protein, 107 aa, Homo sapiens
AISFFSDTRTVVRYMDPYTFFCDLVIVCLGLVFSFLILCHWPHVSCDVSLYSASFCMHPFCAYIMENYKNTYLRISLLVMEQEIAKVAFGVRLLDFFPLIVTYLKCC

SEQ ID NO: 779390 - protein, 73 aa, Homo sapiens
MCQHGNDKRAHEGNKPRGDRETGQQDTPDRIRKTRPGGETGAVCAKNPKGQAQRAHKGNITSTRPKGHGDYKR

SEQ ID NO: 779391 - protein, 73 aa, Homo sapiens
KLRSASLSVGDPHITCTHATSGTSTEHEGFLGNLSAYFPPRLPNYHGKEHGTTESVCCVVTTVKAATFLYLGC

SEQ ID NO: 779392 - protein, 73 aa, Homo sapiens; identical to SEQ ID NO: 779391

SEQ ID NO: 779393 - protein, 130 aa, Homo sapiens
MGDLDNSAFAAWAPFCSSSTRALSAPGHWGFEGRQFPAAPARLGGRRPRVPVGGRPRQPAKTSRHRNLRRLPPMRASGAPSLPGGRGEGRVAPGGGLRATGLRCASVDTAPPSASTALGSGTFGNRFGRS

SEQ ID NO: 779394 - protein, 109 aa, Homo sapiens
MGLKRPLAGGSWACQSGREAGALDLGGRSEARASWAWRVRCEAEAGPVQAFGRQEAGKAAGRHELGWAERGRWEAGGAGPGEADSRNFCTWSGRREAGAGPGEADLRTT

SEQ ID NO: 779395 - protein, 30 aa, Homo sapiens
HLPPGFLHLSKLQKLTASKNCLEKLFEEEN

SEQ ID NO: 779396 - protein, 242 aa, Homo sapiens
HRLNFSSLSWPGHILSNHSCSPSFAPSSASPRLSEAAGGAGRIFIHLLGAQESDPGPRLLQQVGASVTSASPYWLWRHLVDASGSAGTAALPVTQKQNQQFTWPYIIFESRIPRVHSQPSSACIVHCLLSAGPTHLHLTSTGTQTEPLPLKSQPHTQLCAQKQAFVLTKQNETTQTSLKMGSMHSTEYYEMDKRVCWIGNVSKSTLKNNTYRMMPFIGRNKPKPDPLFAYPCEMQREGWTHT

SEQ ID NO: 779397 - protein, 125 aa, Homo sapiens
CSFCSDAGFSGCPLRPIFPASCCPFLHASSVVRLPRVASLTLISGWPSSCGFGDYLLSASWPSVSGPVMAPELWPRHLQSLPGGPLCSPRQAPACMLEFGCPSLSLVPSFLCYPPPLGQQVRSVL

SEQ ID NO: 779398 - protein, 155 aa, Homo sapiens
MELRSGAAYSAQRMAGLVLPDFRYGLLLGLDVWASWLDHQWLKQTLALLSSGPAQLVLAACSGPQRWGAAFGSLCELGLCPSPHGASLPSTALTLTQLVLAARSSTGAYALRLCTGPPAPRPASLACVSDCAEGHWEKPGQDAGCTDDGDHTGLP

SEQ ID NO: 779399 - protein, 67 aa, Homo sapiens
FSQGITGLTLGEREAMHAANTCTPPFILPRLLLSGAQACKFVDQCAPQSVLISASPPRGSGDRGSGK

SEQ ID NO: 779400 - protein, 129 aa, Homo sapiens
IWLNLGYNCATLVTGDMGRCCCQWILFMKTHQRDAYWASAPKKGHDPPEQPVHVCLTDSRNHLINTIFQVCSSCCKAQDQSHGASLSPTKNFVVCVLHIDLVLHYFLSFSLHPLIWFRSVSLPKSHVKL

SEQ ID NO: 779401 - protein, 91 aa, Homo sapiens
QRNKLGMTNVHANCPAPVDTSPRVRWHLARYTGRDPGRWPLRSLRGSVLGGTVIVPHDCLALGQGTICLELCNAVGYLASFPNPQGASWSF

SEQ ID NO: 779402 - protein, 91 aa, Homo sapiens
WSAIDTNVLSYSSRSQKSGIRFTGLNPGVGRAVCLLETPGENLQATSIPWLNSWPFLHLQNQQSLVRSFSSCITLNSFSQAQSTLPLIRPT

SEQ ID NO: 779403 - protein, 135 aa, Homo sapiens [sequence omitted]

SEQ ID NO: 779404 - protein, 56 aa, Homo sapiens
MGDPFLVGEIGLLAFKSAADEGQKQDQDSHVLLLEMFSKLLELLTLRHRLIEMSLE

SEQ ID NO: 779405 - protein, 69 aa, Homo sapiens
LRATPRPGIDLEDTKLMVQAATVALGGTQIRGPDGRARRSSPSGSSSSDVPSLQSLTEPRPPKVLGLQA

SEQ ID NO: 779406 - protein, 131 aa, Homo sapiens
MVSGNSVFGVVEPLPVSVVGRLGIPFLQWADSAFAEVGAFAEVAKVTLAKAGLVEIGQAEKMVVAAAAAAVVAVVVAAAAAVVAAAAAVGLKLSSAAVAVVELKLNSAVAVAVAVAAAAAVAAAAAAAAAA

SEQ ID NO: 779407 - protein, 114 aa, Homo sapiens
SRKCQAFLSMYSKRGGLKPSPHSGTSLEQFLGARHISGASLPVRGSLPASISSRPSPWGGSMMHPSSAQGLGPWSRAGDTGALAGGQGVDNGDNGTRGHPGEPDRPGMGSPVFE

SEQ ID NO: 779408 - protein, 216 aa, Homo sapiens
READGILNLFAKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSWEMHFLELKKDPDMVKDIINEEEVQFLKTLSRGRRILDRKIQSLGDSKTIPGDTAWLLYDTYGFPVDLTGLIAEEKGLVVDMD

SEQ ID NO: 779409 - protein, 127 aa, Homo sapiens
READGILNLFAKKSIDTGMGLERLVSVLQNKMSNYDTDLFVPYFEAIQKGKVPDHHTFFEMLGSWSFGDYFKELACKMALELLTQEFGIPIERLYVTYFGGDEAAGLEADLGMQTDLAKFWGWMTTK

SEQ ID NO: 779410 - protein, 133 aa, Homo sapiens
QAGVQWYNLSSLQPPPPRFRLLGSSDSPASAYRVAGITGTCHQAWLIFVFLVEMGFLHIGQAGLEHLISSDPSASVSQSDGITGVSHHTQPNVGSFYNPYCLGVMCQKSQYLWLPQLFLQITSPIDSLSPRDQ

SEQ ID NO: 779411 - protein, 45 aa, Homo sapiens
AHLKSIKPYLEYRHRREGKYTHTKLVLQFKFLSKKKQVRMSLLSK

SEQ ID NO: 779412 - protein, 126 aa, Homo sapiens
LFCHSIKHSFTLLTLHLSAYLILPGCGTKTQDPLNGGAERAVTQTGLKHTPCLPHGGQREGKRGKRRREELWPFKEPRPRSSLSQGYGSLFGALQSLASPSFQAPPHSLVPPMEAACSMPGPAAAL

SEQ ID NO: 779413 - protein, 41 aa, Homo sapiens
MGAFDVKTLAPVQALPSPRCLQHHMELGSPGVSDRGRLQPP

SEQ ID NO: 779414 - protein, 171 aa, Homo sapiens
SLSVCVCVRLGTHVPCAPECGFLARRPFFWSASPRVSAWVVWPVGSRRPGGSSLGVCEGLGNVGIGVGPAGVFIPSPSGAASLLGWIQTSAPQPRTTASQALIVHPQEGARRASRRWLSRLSPSALIEKCSHSSTQGRRRKPARGWGKHVCLSKAGLPGRVTRLTLLPGCR

SEQ ID NO: 779415 - protein, 92 aa, Homo sapiens
VAISHATSTAQGLKNPPNSLAHCCHSQHLIKLPGGSRIGLLTLVPADTLWGPGTGMLNPQLPPLRPEDWPTWHSRPQQNFTTASTNNCTLSH

SEQ ID NO: 779416 - protein, 117 aa, Homo sapiens
MSGGLDLCPVPGVSAHWIAAVVPSLPVTSSPDIKPSVSFSFCLGLQMQLRDLRRLREGGAPPAAGRAGATLLSDCIIFPSPSAQLISLHAYTGPNTHTRVHAHRHTCASPNTSHTCM

SEQ ID NO: 779417 - protein, 195 aa, Homo sapiens
DSRLSARRRPRCNFLRSSRIRVHPTPAASTMPPKFDPNEIKVVYLRCTGGEVGATSALAPKIGPLGLSPKKVGDDIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 779418 - protein, 113 aa, Homo sapiens
MAVLLPPPSPTSPFWVHWLTTVFVSDKSLQRTAFWELSHRARLSSLPSCMLGQLPHPPSQPSPTLCWARAAVSLAGLCAKSRHHPSSPQQASSRVLEHSRHSVWTGRALKEFS

SEQ ID NO: 779419 - protein, 104 aa, Homo sapiens
MQGPPCAPPHTGTEGTEKISPSPCPGGTHQRQWRGWVRVQATGLEDPKPNPSSSYLRWVPLVKRHFTLCLSLLFCQVGRAPETTSWGSCEEKERECKRSGQYTA

SEQ ID NO: 779420 - protein, 75 aa, Homo sapiens
GGGLRAPPELPLLAIAPPHKAAGSHFSEGLACKKCPPECWPDKWKSARVGYPHDSSQPALLVPDSCSDSICDCKA

SEQ ID NO: 779421 - protein, 143 aa, Homo sapiens
GLAYGARLSIMRSRIVVQCQPAVTVRHGVGIALQEMKTTSLSQGNELEVSIMMVVEALCELHCPEAIQGIAVWSSSIVGKHLLWINSVAQQAEGRFEKASVEYQEHLCAMTVVDCCISSFDKSVLTLASAGCKSASLKHCLNG

SEQ ID NO: 779422 - protein, 51 aa, Homo sapiens
RPAGKSLKKVELDSQAQALLPSTSSEQASVPWPSSNRLSAFEPSPWICQPP

SEQ ID NO: 779423 - protein, 128 aa, Homo sapiens
MKPHCRGVKGNEQQESGKICKRKEKDQSEGPRESKNQPCCQWRWEWKSEVSEDIVGIRQKTLKAQKRQESFSSFSRSGPGSQLNTKLQKAQSFDVASVPPVAEWAVPQSSRLKYRRLFNSHDKTMSGH

SEQ ID NO: 779424 - protein, 102 aa, Homo sapiens
GGWAFLVPSLAAVEAEDSQDPGEDTVLWWPGLWAPGAEGREDGWGQGSGSRGTLSHLLRWAADGLCERHWCGQRTRETAASQAGRELAQPREAPLPGNEAKA

SEQ ID NO: 779425 - protein, 88 aa, Homo sapiens
DDGGDEDEDEGADEDEGGDEDEGGDKDEGDEDEGEEGDEDEGGWGDEDEDDEGDEDEDDGGDEDEDDGGEEDEDDEGDEDDEGDGRDE

SEQ ID NO: 779426 - protein, 111 aa, Homo sapiens
RKQRIRGRRDHGGKEQLTGSRQTREKAKKERKEVACSQEILTFKKAINNDAQKAQDFHFSNSEQEEKSSSFHAGRLRIEGGHVWYYREILKWESGDSALLLFSCVTLGKSL

SEQ ID NO: 779427 - protein, 75 aa, Homo sapiens
SSGNPLMFPGFVFLLFVISLAAAAHLWVLAAFMGRITVKVCSFTPEASKTVSPPEGANNSRRTAFKSCNTHHKGL

SEQ ID NO: 779428 - protein, 89 aa, Homo sapiens
MGWVWWETDLDTGKDIAYSVPPTHHPLKASNGKRPLGPEDNEEQRGRLTLPLWLWLQIQGLSEQEKEHSPQASRVLGTGWAEGIYTNCA

SEQ ID NO: 779429 - protein, 56 aa, Homo sapiens
SSLQVFFAHRLYAPYGSDSRYSHEQDPGPFLLGAHSLVEETEVVTRYSSVLGEGEA

SEQ ID NO: 779430 - protein, 210 aa, Homo sapiens
MLKCFRNCLRPSSLSTLPLQYGILFPKLLACLVHLHFGHFSSAVISVTSFYLSMNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 779431 - protein, 71 aa, Homo sapiens
MRRASRITTSRARSGSGPKLPPGQEVMPEVSPKGQQQPLPWNRDAVGPCHPSPALPSGCCADPGQEAPSSL

SEQ ID NO: 779432 - protein, 37 aa, Homo sapiens
MRELLLLPKWVDTRVLLNILPEGQDCPTRKNDPAPNK

SEQ ID NO: 779433 - protein, 249 aa, Homo sapiens
VRDMMFYWLLSIVGRQRASPGWQNWSSARNSASAAEARSMALPTQAQVVVCGGGITGTSVAHHQSKMGWKDIVLLEQGRLAAGSTRFCAGILSTARHLTIEQKMADYSNKLYHQLEQETGIRTGYTRTGSIFLAQTQDRLISLKRINAGLNVIGIPSEIISPKKVAELHHLLNVHDLVGAMHVPEDAVVSSADVALALASAASQNGVQIYDRTSVLQVMGKKGQVTGVETDKGQIECQYFVNCAGQLWS

SEQ ID NO: 779434 - protein, 211 aa, Homo sapiens
ASCLSDVEYQNSETNSSFASKVQNGIQNDVSQRTQFPSTENIVVLSLSLLIIPFVPATNLFFYVRFVIAELTYYIFLDMGFCLLYYSWRAKALDVKVQKRFLKSLIFYATCYTNSSSMDSRLRSGMETDRMRNTALYRSGIQVNPAKAWGNLGNVLKSQSKISEAESAYRNALYYRSNMADMLYNLGLLLQENSRFAEALHYYKLAIGSRP

SEQ ID NO: 779435 - protein, 112 aa, Homo sapiens
DVEAPRAKLDGARLEGDLSLADKDVTAKDSKFKMPKFKMPSFGVSAPGKSIEVSVDVSAPKVEAEVSLPSMQGDLKTTDISIEPPSAQLEVQAGQVDLKLPEGHVPEGAGLK

SEQ ID NO: 779436 - protein, 81 aa, Homo sapiens
SSSRHSSSPSSCSSSRHISPPVRFLLSPTIPPFTSLTHTPLLETGAGKTGVGLLSLTGAETEVCHKVPMFELTFGGQTVCQ

SEQ ID NO: 779437 - protein, 37 aa, Homo sapiens
KAASGGALWEVCEVLRKVLQEQEKAGGAFSPSVAVPP

SEQ ID NO: 779438 - protein, 102 aa, Homo sapiens
HCLRLKSELLGTLKAASLSPDCRVPGCCTGPSTVSKAVPPLQGSLLRLLQILSHNSAGDFTRHCLRVALPLNRTPPTGKALRGFISVSPMTGTLTGTQKGAQ

SEQ ID NO: 779439 - protein, 65 aa, Homo sapiens
MVNPAPFSMPRQVRPLERRKYMLKSLDQIETVNGGSVASRLTFPDREALAEHADLKSMVELIKRM

SEQ ID NO: 779440 - protein, 120 aa, Homo sapiens
MTHNDHLAPSMLWEMQHCKKQTKTNKQKNKTPTKWGENRSSIKKKVFCILNKIENIFFQNMKTQLQITPQGHLRKRSPIHKDTVYIIQQNMHSQMILSDNTEEVTAYHSWNAFVQNSERP

SEQ ID NO: 779441 - protein, 108 aa, Homo sapiens [sequence omitted]

SEQ ID NO: 779442 - protein, 90 aa, Homo sapiens
ARSAVLPPVPSEVHGPTAPRPPSALASTLSFHFSQLSPIFRKCSSRGSLSPLAGGARVCASDHMDPCTTICSVLSLWSAQLIKQALVRKI

SEQ ID NO: 779443 - protein, 111 aa, Homo sapiens
QSNPSGPAWSWWILAVLPLERKAQLAILGMTSLKERLLAIRRILVIITRKMNSRQELANARERNELIFLSVKVSGSPCAFINVRHGRIAVHSLCFIKCLWMRFQNGTLAKH

SEQ ID NO: 779444 - protein, 49 aa, Homo sapiens
PQSERTAPGALDARAGRCPPPPPFPRASRGVLSPPPLRRSRVTAGGRGA

SEQ ID NO: 779445 - protein, 258 aa, Homo sapiens
TGLSQPVLRQPNMSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSP

SEQ ID NO: 779446 - protein, 136 aa, Homo sapiens
GAARPKHPARIAEPAPCAGGNEDLELGARVWILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 779447 - protein, 207 aa, Homo sapiens
CSLEPGRFESAVTLMAPLHSCLLGDRVRPCLRQTKTKGLPGAEACSHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 779448 - protein, 136 aa, Homo sapiens; identical to SEQ ID NO: 779446

SEQ ID NO: 779449 - protein, 107 aa, Homo sapiens
CSLEPGRFESAVTLMAPLHSCLLGDRVRPCLRQTKTKGLPGAEACSHPWDTVIQAAMRKYPNPMNPSVLGSGCATAPRGRPRPPAQLAPAQHRVGAAQPRESDFGNQ

SEQ ID NO: 779450 - protein, 35 aa, Homo sapiens
SYFYALPGGNSGLLSLYDVITGWGGPQIFLGKGGL

SEQ ID NO: 779451 - protein, 150 aa, Homo sapiens
DSCLWGMEDKNIIQFVHGEEDLKVQHRGEEQRARLLKDQLSLGNADFSITDVKLQDAGVYRCMISYGGADYKRITVVNAPYNKINQRISVVDPVTSEHELTCQAEGYPKVEVIWISRDHQVLSGKTTTTNSKREEKLFNVTSTHLSMSRL

SEQ ID NO: 779452 - protein, 66 aa, Homo sapiens
PSCSMKTGFPKSRTSQLSYQVANGSSFSVHSGYWNISQSKPPSPPGTARFCRSMAAASGPVRGKLS

SEQ ID NO: 779453 - protein, 116 aa, Homo sapiens
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGT

SEQ ID NO: 779454 - protein, 219 aa, Homo sapiens
PAGPARVSAVGTRGRRDSPTVGRREAVPAGSSPGSTPRRRGGWERLSLSPRVWSLGCEEAGEAAAGRRWVWRGRPDCGDPLRAQWLSARLSFQGLRIRRLGCTMPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGT

SEQ ID NO: 779455 - protein, 117 aa, Homo sapiens
EERVPQSSFIYLFRDKVSLFRSAVVITLLGRLRHENRLNPGGGGCSELRMHHWTPSWATEQDFTSQKKGGEGRTTALYQDSENKNDLTIPSFGKDRSLNCLTLLKEHTLVQLLWKPI

SEQ ID NO: 779456 - protein, 234 aa, Homo sapiens
MSSEQSAPGASPRAPRPGTQKSSGAVTKKGERAAKEKPATVLPPVGEEEPKSPVLVDGEKELRSWRNNIFWKGRQDSIQSPTEEYQCSGVLETDFAELCTRWGYTDFPKVVNRPRPQPPFVPSASLSEKATLDDPRLSGSCSLNSLESKYVSFRPTIQVELEQEDSKSVKEIYIRGWKVEERILGVFSKCLPPLTQLQAINLWKVGLTDKTLTTFIELLPLCSSTLRSADWEAP

SEQ ID NO: 779457 - protein, 205 aa, Homo sapiens
MSSEQSAPGASPRAPRPGTQKSSGAVTKKGERAAKEKPATVLPPVGEEEPKSPEEYQCSGVLETDFAELCTRWGYTDFPKVVNRPRPQPPFVPSASLSEKATLDDPRLSGSCSLNSLESKYVSFRPTIQVELEQEDSKSVKEIYIRGWKVEERILGVFSKCLPPLTQLQAINLWKVGLTDKTLTTFIELLPLCSSTLRSADWEAP

SEQ ID NO: 779458 - protein, 66 aa, Homo sapiens
RIKWDHCRSGTAGELQYASEGELEGSAIRPSLQLQKTWALPLMAVLRLGRPRPNTVIFLLGNNDPK

SEQ ID NO: 779459 - protein, 84 aa, Homo sapiens
ADGGKFPEEGRWLNPGRAAAGRKTSEALTTRRGCRRRCYGREPPRPAPSVIIQGILVHHRAHDLGSRHYFVISVLEEERHSDWH

SEQ ID NO: 779460 - protein, 43 aa, Homo sapiens
MLREPAGRKLSAVEKEREEMEEVSGTTELEKNLLLSSPKSCVC

SEQ ID NO: 779461 - protein, 123 aa, Homo sapiens
HAPHSGHSSSAGLSSSGHIASAGLSLSFDHSLSAGSSSSFSLSFGLTASAGSAPPTGPTFYDYAPYAGPALSPDHSPNTGPTFSDLTVSAGTSLCSGFVLSAGHNFFGLTHSAGHTFFPDNVP

SEQ ID NO: 779462 - protein, 67 aa, Homo sapiens
MIGGAGASGCGGDGGVDGDDGGGSDGGVDGGDGGSGDDGGDGDDKVVVKVELMVMMEVVVMVELMVV

SEQ ID NO: 779463 - protein, 150 aa, Homo sapiens
DPTLLDRQSRSVVDVLKRNKNFKAIEKINSHLEKLATCSKDLSGFSNGDGPTSENDIFRKVLEQLVKYMNSGNRLLHKNFLKQEVVQRFLRLLSTLQEIPPDLVCDINQDCATTVFKFLLEKQRWPEVLLLLTRKVSGEPPLGDCLIKDC

SEQ ID NO: 779464 - protein, 427 aa, Homo sapiens
FSPTRIKRKKVNMVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWVFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 779465 - protein, 123 aa, Homo sapiens
EHIETVAGSSSKGFQNSKKKEEGPTKSTEVFIAPDSQIQHREQEMAEPSFHRQVVKMSSKPYSSLVAEPGPKTRSPALLEKSSFRWAVGCLHCHPPCWRKRRWGGTFTPIRVIQDAQLHWQFK

SEQ ID NO: 779466 - protein, 113 aa, Homo sapiens [sequence omitted]

SEQ ID NO: 779467 - protein, 80 aa, Homo sapiens
GKKSYGGEVSFKEPRTHAEARQAAWPLSCASRSRDDYKEELEGRRKRSGGITRSENGWGVIEKFFGGGDHELCLRGQRKQ

SEQ ID NO: 779468 - protein, 138 aa, Homo sapiens
PSGPHDHCEWLGNPGQALPTDLRKRTPGSRGRFSSREAGSCWGSQTVPPCLSELQLSLCSLSSLSAPFCSAVTVTQPEPVSLFSRQWDLRECLCCVYAATTFSGSGVSGCEAGSSAGRKSPEDELRPLQQADPLGQEG

SEQ ID NO: 779469 - protein, 105 aa, Homo sapiens [sequence omitted]

SEQ ID NO: 779470 - protein, 98 aa, Homo sapiens
TASLTQTSHLSNGDIWEQHPLYEATMETKEPIVYTGSVERAPGECSGMTLLGSCPTEANTARTVATAPKSAWREESRSRSPDSDESAGLGHASQGENL

SEQ ID NO: 779471 - protein, 129 aa, Homo sapiens
PEKAERGADLCSARRLAGQGRGCQEAREQSRRSGAERALPGSPSAQRMRSVGARPEVGALGRRSPRTPLSTAPLSVRPPWTPSIPKPRQPIRRLGRPQAQRDTTTTTRRHHRRSTWGGTYKASRLTPVS

SEQ ID NO: 779472 - protein, 68 aa, Homo sapiens
AEPPSSNHIRKESETNAPLAVTPYPLAVRCPNSVIRCPDMRPQWTDPGWKGRVRRNQTEEFRRCGNRV

SEQ ID NO: 779473 - protein, 131 aa, Homo sapiens
SVTHDGPQLNDGPQLNDGPQLNEGPQLNDGPQLNDGPQLNEGPQLNDGPQLNDGPQLNDGPQLNDGPQLNDGPQLNDGPQLNDGPQLIKNSTGKTRPHDSIISHWIPPTTCGNCGSYKMRFGWGHRAISVV

SEQ ID NO: 779474 - protein, 270 aa, Homo sapiens
MAQFNLLSHSNSLRATNTFQSSTVHFGHSTNTHLNRPFKSSHTGNSTATSTIHSGPNLESRTFTTTLLRNHTTHPQELIPCPALSSSSSIHATWAQTGSIKDCPRIPGWKHHFQRSAGTPGKLRPTYTQKRDMPHIHRCDPRRDTNSNRTSTTSPDMWHTLAQRSKQTQAHNHSKNITPTKAYGAPPQSQTTIEHTKKQRTKSSREATSTAPTLPKPHNLDDPANRTIRIMNTPGVRKCHSRQRKTERTRVQQGSTNIEIHTQTIHAPHK

SEQ ID NO: 779475 - protein, 86 aa, Homo sapiens
ESSLPWVGSEVGEVASKASLLTLGACTPSPLCFLKPTMSRPSLVPGPEEEDVALPTDKHEEEQTFACSTFQSRGKDSCDMSPPAAL

SEQ ID NO: 779476 - protein, 42 aa, Homo sapiens
EEKMQGQEEKMREQEEKMRGQEEKMWGQEEKMWGQEEKMWGQ

SEQ ID NO: 779477 - protein, 75 aa, Homo sapiens
KLCYSPLICSPLTMAVSISATEVETAPLKAGSVIKGSRDWARWLTPVIPALWEAEAGGSRGHEFETNLSLVKVQK

SEQ ID NO: 779478 - protein, 35 aa, Homo sapiens
MCNSLDVESYLDMGCEAQTGTLCLSKPLVNHPCTI

SEQ ID NO: 779479 - protein, 37 aa, Homo sapiens
RLAPERWSAKGLAGGEEEVILQVFVLIVIPNCLPGIR

SEQ ID NO: 779480 - protein, 44 aa, Homo sapiens
MRDRKRKGQRLSFFSEVEIRHPLLAFLNSFSFYSSTLSGPKYQK

SEQ ID NO: 779481 - protein, 61 aa, Homo sapiens
GVTPLVGGILREPSGNLPGSLRGYPHLPGGEKGESLATLLSLKTIRVRERFLGAFWSFSSV

SEQ ID NO: 779482 - protein, 742 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIHWHR

SEQ ID NO: 779483 - protein, 742 aa, Homo sapiens; identical to SEQ ID NO: 779482

SEQ ID NO: 779484 - protein, 877 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSPCPLPPPHPLAPVLSFSSLSCSSPPSPLPLLPLFSSFPSFSPHLPSPPLLSSQLSMFLQHKFAEHVFTPRSPYPQDWWEKRLAQCLALSKHAAHASRCWYCSHFQEPATGEVRAGCFGTGSLVALGLSSLNMIQSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIHWHR

SEQ ID NO: 779485 - protein, 742 aa, Homo sapiens; identical to SEQ ID NO: 779482

SEQ ID NO: 779486 - protein, 742 aa, Homo sapiens; identical to SEQ ID NO: 779482

SEQ ID NO: 779487 - protein, 759 aa, Homo sapiens
CWYRSGKYGIAIGVPENMAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIHWHR

SEQ ID NO: 779488 - protein, 698 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWHR

SEQ ID NO: 779489 - protein, 409 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMARGPRYPQGTYCACPPAT

SEQ ID NO: 779490 - protein, 633 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEANGCGYGRGTCQGPDEGPDEYRG

SEQ ID NO: 779491 - protein, 758 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKNPELREETPLSMAPSWYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIHWHR

SEQ ID NO: 779492 - protein, 734 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSPCPLPPPHPLAPVLSFSSLSCSSPPSPLPLLPLFSSFPSFSPHLPSPPLLSSQLSMFLQHKFAEHVFTPRSPYPQDWWEKRLAQCLALSKHAAHASRCWYCSHFQEPATGEVRAGCFGTGSLVALGLSSLNMIQSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKVGAGWEQLCGGRAGMGVLVTLQPLKAQSLEPSLTSPTLSFHCTGSLTRASCPRLLSLMLSECLAVWPGGSHRLCQRQLPQRRSSVCCLLLPSLTSLDSLLRSSSNPESLSAGRMPSMGFGSHTLFSPPRRSLGST

SEQ ID NO: 779493 - protein, 570 aa, Homo sapiens
MLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIHWHR

SEQ ID NO: 779494 - protein, 638 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQIPSVHSE

SEQ ID NO: 779495 - protein, 557 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQK

SEQ ID NO: 779496 - protein, 114 aa, Homo sapiens
AHARSSCAERDEWYGCLSRALPEDYKAQALAAFHHSVEIRERLGVSLGERPPTLVPVTHVMMCMNCGCDFSLTLRRHHCHACGKIVCRNMLRRNNEPAEDTERTRVRGDALESA

SEQ ID NO: 779497 - protein, 207 aa, Homo sapiens
AAASTAAPSGTVSDSESSNSSSDAEELERCREAAMPAWGLEQRPHVAGKPRAGAANSQLSTSQPSLRHKVNEHEQDGNELQTTPEFRAHVAKKLGALLDSFITISEAAKEPAWPQSRSRSQVSSTGTRCRLGPKRRKRQRRPARPLHSHQQRVLQLYLQTEPSHGHRAQPAPRTRCPPHPGDKAFPSPTSLSKFKDWAGKPRLPMRP

SEQ ID NO: 779498 - protein, 249 aa, Homo sapiens
TTTKFAAGRRWCTGRMRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 779499 - protein, 255 aa, Homo sapiens
LWCLVAVPGALSSSWSWCTGRMRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 779500 - protein, 131 aa, Homo sapiens
HIFIHTSIHPFTHPSTHSSSICPSIHPMCLLAGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 779501 - protein, 131 aa, Homo sapiens; identical to SEQ ID NO: 779500

SEQ ID NO: 779502 - protein, 255 aa, Homo sapiens; identical to SEQ ID NO: 779499

SEQ ID NO: 779503 - protein, 271 aa, Homo sapiens
LWCLVAVPGALSSSWSWCTGRMRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIREKSMTFGIRRLDVESHPLPPLHTGHFRISQFFSQAGTQSLHSCYKGKPTP

SEQ ID NO: 779504 - protein, 138 aa, Homo sapiens
MVAVGENPGSSTHWGLLSHRPPPCRSHTPRPCCAAQQVRAPCPSHGPQCTILYAVISGQQPWDAGPAVHTCHMNLHGEAHSSPHLSTLSLQHRGTAASWFPQQFFSFSDSSLVTESVQGASVQEGTAENFQEGGKGPN

SEQ ID NO: 779505 - protein, 138 aa, Homo sapiens; identical to SEQ ID NO: 779504

SEQ ID NO: 779506 - protein, 168 aa, Homo sapiens
ILAPVRRATAPRRTLLRVNTGLEATDTQPQCSGFSPAGPAAAHSGHRHRLLQLRSAQPLRDARCALAPGDPRPAQARQRAGVVTELGAGFAFPACLFSAQDLLSVEPSGGGEGAAPPPPPPPPPLLLRSLARRAGQAEAGEWTRSCLPRRRFGLPLSRFPREPLQPST

SEQ ID NO: 779507 - protein, 59 aa, Homo sapiens
CFTQQKANKTKSWLRGRSAVQLHEYRCFLSLNPSSVAYLGHTESAIGYNFKTKARDSVH

SEQ ID NO: 779508 - protein, 175 aa, Homo sapiens
RARQMREAGVRFRARREEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 779509 - protein, 171 aa, Homo sapiens
MFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 779510 - protein, 165 aa, Homo sapiens
MFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSLLPASWRLVSKSR

SEQ ID NO: 779511 - protein, 241 aa, Homo sapiens
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 779512 - protein, 206 aa, Homo sapiens
TASGFPQIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTRSSACTRRPGPAARPRPLPPDTAGRAQGHSQSPRRALPAKQKPPGQGPGLSWSCLW

SEQ ID NO: 779513 - protein, 115 aa, Homo sapiens
MLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 779514 - protein, 825 aa, Homo sapiens
MFSGFNVFRVGISFVIMCIFYMPTVNSLPELSPQKYFSTLQPGKASLAYFCQADSPRTSVFLEELNEAVRPLQDYGISVAKVNCVKEEISRYCGKEKDLMKAYLFKGNILLREFPTDTLFDVNAIVAHVLFALLFSEVKYITNLEDLQNIENALKGKANIIFSYVRAIGIPEHRAVMEAAFVYGTTYQFVLTTEIALLESIGSEDVEYAHLYFFHCKLVLDLTQQCRRTLMEQPLTTLNIHLFIKTMKAPLLTEVAEDPQQVSTVHLQLGLPLVFIVSQQATYEADRRTAEWVAWRLLGKAGVLLLLRDSLEVNIPQDANVVFKRAEEGVPVEFLVLHDVDLIISHVENNMHIEEIQEDEDNDMEGPDIDVQDDEVAETVFRDRKRKLPLELTVELTEETFNATVMASDSIVLFYAGWQAVSMAFLQSYIDVAVKLKGTSTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTAKEDFSEAGNYLKGYVITGIYSEEDVLLLSTKYAASLPALLLARHTEGKIESIPLASTHAQDIVQIITDALLEMFPEITVENLPSYFRLQKPLLILFSDGTVNPQYKKAILTLVKQKYLDSFTPCWLNLKNTPVGRGILRAYFDPLPPLPLLVLVNLHSGGQVFAFPSDQAIIEENLVLWLKKLEAGLENHITILPAQEWKPPLPAYDFLSMIDAATSQRGTRKVPKCMKETDVQENDKEQHEDKSAVRKEPIETLRIKHWNRSNWFKEAEKSFRRDKELGCSKVN

SEQ ID NO: 779515 - protein, 807 aa, Homo sapiens
MFSGFNVFRVGISFVIMCIFYMPTVNSLPELSPQKYFSTLQPGLEELNEAVRPLQDYGISVAKVNCVKEEISRYCGKEKDLMKAYLFKGNILLREFPTDTLFDVNAIVAHVLFALLFSEVKYITNLEDLQNIENALKGKANIIFSYVRAIGIPEHRAVMEAAFVYGTTYQFVLTTEIALLESIGSEDVEYAHLYFFHCKLVLDLTQQCRRTLMEQPLTTLNIHLFIKTMKAPLLTEVAEDPQQVSTVHLQLGLPLVFIVSQQATYEADRRTAEWVAWRLLGKAGVLLLLRDSLEVNIPQDANVVFKRAEEGVPVEFLVLHDVDLIISHVENNMHIEEIQEDEDNDMEGPDIDVQDDEVAETVFRDRKRKLPLELTVELTEETFNATVMASDSIVLFYAGWQAVSMAFLQSYIDVAVKLKGTSTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTAKEDFSEAGNYLKGYVITGIYSEEDVLLLSTKYAASLPALLLARHTEGKIESIPLASTHAQDIVQIITDALLEMFPEITVENLPSYFRLQKPLLILFSDGTVNPQYKKAILTLVKQKYLDSFTPCWLNLKNTPVGRGILRAYFDPLPPLPLLVLVNLHSGGQVFAFPSDQAIIEENLVLWLKKLEAGLENHITILPAQEWKPPLPAYDFLSMIDAATSQRGTRKVPKCMKETDVQENDKEQHEDKSAVRKEPIETLRIKHWNRSNWFKEAEKSFRRDKELGCSKVN

SEQ ID NO: 779516 - protein, 52 aa, Homo sapiens
MAMKDDNEGSDDDDRDIEYYEKVIEDFDKDQGDYEDVIEIISDESVEEEDLG

SEQ ID NO: 779517 - protein, 106 aa, Homo sapiens [sequence omitted]

SEQ ID NO: 779518 - protein, 137 aa, Homo sapiens
KGDINEMTIIVEDSPLNKLNALNGLLEGGNGLSCISSELTDASYGPNLLEGLSKMRQENFLCDLVIGTKTKSFDVHKSVMASCSEYFYNILKKDPSIQRVDLNDISPLGLATVIAYAYTGKLTLSLYTIGSIISAAV

SEQ ID NO: 779519 - protein, 102 aa, Homo sapiens
RPRFCSAEVWKEECRKRRKKRIESYVYNTKILTKCKSRNETTGCRSLSILFQCAKHLHVIQHWSSTTDCVNQIRVSGSCAKNIPAQIILADNTRKNKHFSVY

SEQ ID NO: 779520 - protein, 147 aa, Homo sapiens
MGRGGVQVAEQLGTQGLNLGPDTLVSRAWSTNLQYLAYCGPKEGGPCLGKGVPRRLVLQFGVLFWTILLLLWVSVFLYGSFYLFLYATVRHLSPVHFYYRTDCDSSTTSLCSFPVANVSLTKGGRDRGADVWDKRIVVPSELELAES

SEQ ID NO: 779521 - protein, 34 aa, Homo sapiens
RAPAAPLSALSAPRLPERPADGRVAVDAQPAARS

SEQ ID NO: 779522 - protein, 101 aa, Homo sapiens
LPVGFMSFPYNTPCLPGWKRGSRNLETWACSWHMEKRPGKAPLLSMKPPDGTRSCSETPSVPLERLPRAHRPSNRHLWPPGPNPFYIGFSACEYTPGLIPA

SEQ ID NO: 779523 - protein, 42 aa, Homo sapiens
QSLRLPQHRSSKSRQPTVGRDKGSQPDFMYGKTEARVSKKPP

SEQ ID NO: 779524 - protein, 55 aa, Homo sapiens
MKRNEEKRDSRQDCPEKWAEAHKPHKDKDRKSPGIRKKGPWRQGSSLQRQAKGPR

SEQ ID NO: 779525 - protein, 50 aa, Homo sapiens
MSHQGTWALSGFRVARLRMPSQHLPSRICTGRAITPHQPGPHNRMPEASS

SEQ ID NO: 779526 - protein, 106 aa, Homo sapiens [sequence omitted]

SEQ ID NO: 779527 - protein, 106 aa, Homo sapiens [sequence omitted]

SEQ ID NO: 779528 - protein, 92 aa, Homo sapiens
RGAERRAEATSAVLVIGGLSPGTVPGERAVLEPHRVAKQKRHGLAMLPRLIMNSWAQAILQTWPPKVLGFQQRRFKKIPEVVKTLMLNIMFQ

SEQ ID NO: 779529 - protein, 67 aa, Homo sapiens
EDEDAGAAGRAAPRGTGPPQPPQGEPKVAGNTRTRAQPWSATCPTAPSCPPAWLPGPLFSLHIVLSR

SEQ ID NO: 779530 - protein, 177 aa, Homo sapiens
NIALHCLTIAHPLRVCCRCSRQEIKAAAPGSFLFFFTLENRVLIRVHPGVGSCRWVLVLQTSMFNLPTFSQALRCVTLFPTLLGPTVKLRCGTHRASPIQRSATAIKAFWANLLGDKHDCKCVAAQLFAAPGPVGSPLLCNSSQAEISPRLCTHQPVAQKCVRRGAFLSTLWVEGAT

SEQ ID NO: 779531 - protein, 101 aa, Homo sapiens
ISALHNTKKMTGQIAPVSRVRNNAAMSPFLSLSVERQSPSCRRPGQPRAAHHLLVTLTFSGTEDCSALPHNGHRPRHERAGDELQISDLAIISGVDLLKLH

SEQ ID NO: 779532 - protein, 105 aa, Homo sapiens
HNLECPFSTSPGTNPFKIELKPDCLCSMVPDSSKLINPSLLCTHLSLSFCLFFRKVAVFYYHEFFLCVCVVGGFASFGEPQSPVAKDCVLVITLFPPCFSQAVPH

SEQ ID NO: 779533 - protein, 142 aa, Homo sapiens
MACFLSAIKTRFNLLTGLFLVLFFQLIFKRWVSLCYPGWSAVAIYRSNPTTDQRGSFDMLHFRPALVHPSLGNLVVPRSQEVTIFVLDLAGTPSGYSTLQPRTPGLKRSSHLSLQSSWAYRHVSLCLAIFLFFKGRYTHRMS

SEQ ID NO: 779534 - protein, 44 aa, Homo sapiens
DHRAMPVHSCLQGSRSLDTRWASIPFRQLSVSGALGLLLPTGAI

SEQ ID NO: 779535 - protein, 30 aa, Homo sapiens
PHSRLRALGAGGAVRSPARDGAKRRASFGR

SEQ ID NO: 779536 - protein, 76 aa, Homo sapiens
RTQVYCTVHINQCRMEKSGKGGLSGGRSRLHLIDLGSCVKALSKNREGGSGLCLSLSALGNVILALVNGSKHIPYK

SEQ ID NO: 779537 - protein, 65 aa, Homo sapiens
MEGLEANAEWDVGPPVRMAVLKQSTSSKGWRGCGEAESLYTVDGKVLHGFHILSPPPTSPPLACS

SEQ ID NO: 779538 - protein, 119 aa, Homo sapiens
VFLQNNFMLVWLNPSNFSNLGLAFKLFSHLEAHTVKECTFVTYTMCGASLEFPFLNMTFFSINGPKLIASFHSASLDILQHFSKPSFIDGIAFQGSGRYAGGISRISLCPGQGHITNLV

SEQ ID NO: 779539 - protein, 137 aa, Homo sapiens
MVKLLPAQEAAKIYHTNYVRNSRAVGVMWGTLTICFSVLVMALFIQPYWIGDSVNTPQAGYFGLFSYCVGNVLSSELICKGGPLDFSSIPSRAFKTAMFFVALGMFLIIGSIICFSLFFICNTATVYKICAWMQLAA

SEQ ID NO: 779540 - protein, 138 aa, Homo sapiens
LLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRAL

SEQ ID NO: 779541 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 779542 - protein, 555 aa, Homo sapiens
GAGCLGGCGTRLLLSPGHTCPPPPPSGIQAPVFEIDVPRGTPAPLQCFLGPVGGTPTGTPRGLLQCGLCVHWSPEEVPAVTSVHSRRPSRSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 779543 - protein, 53 aa, Homo sapiens
MEFLGTNCVPGDLSKAGTGFWLSSNWRNCVIDFIPAVMGGHRKIQQVKCSHWL

SEQ ID NO: 779544 - protein, 101 aa, Homo sapiens
VADKPSLAQLTPDPLPSLPPCRRIETLRQTARSPSPPPRPHHPVNFSQPPPCPHPARCSPSLAPSPRHPCSRAAPEASTYPRGWGRGSAPPLPLQLEPGCD

SEQ ID NO: 779545 - protein, 116 aa, Homo sapiens
ERWGIGEGDRGISALPPEGRSVPDTQNCGISPGAHPRHTTTYCGSPWSQLVPLLQQEQGACPEPGCVFMMGLLRPPAFLNTEAAAFRTSLSNTLMHQRIAAPWELGPKCQLHPHRL

SEQ ID NO: 779546 - protein, 92 aa, Homo sapiens
THQATDNGARGANLSSPQTQSPTDNFSCPHMRLPTNNFSCPHTRFPTTTSAPQHDTHGGRSWGHFTTSSCTLQHGLLQAEGRPGEEPGTTAD

SEQ ID NO: 779547 - protein, 70 aa, Homo sapiens
MSPDTSTRSVTMLSTFAGLTKSEERTIATQTGPHRATSQGTLTWDTSITTSQAGTHSAMTHGFSQLDLST

SEQ ID NO: 779548 - protein, 112 aa, Homo sapiens
QDPACIFKVEPVFADSLDIVVDMKMCCLYPPSRKDLLISCRECEEQKSTSISTSSATAIEKASPEVTLVLDLRAALSGDVRPCYFSLIYYTVRQNLPQSSLYYNLISSSAQS

SEQ ID NO: 779549 - protein, 116 aa, Homo sapiens
CVRGMKDIVRKGRAWSQHREDPCKREATLKRGLQMHLLIFSLGEMCNKHHACQALSLGVELTLTNFTLQVRDSHSIQLIVSEKGNQESQGPYSRILKQTKWLSAVAHTCNPSTLRG

SEQ ID NO: 779550 - protein, 117 aa, Homo sapiens
FLLTCSQTPFISLSPFSYSLSLLYYLSPQAHFLCLSLISVSFSFSSSPWLSTCVVFLVVGNFICSSDITILFTLRVDDARLRVFCLCGGTFICISDGFIIELQMSSGYPNRKLIFSW

SEQ ID NO: 779551 - protein, 128 aa, Homo sapiens
AAAYYYYYYYEDSRPLDQGLRSWILKESFISTRAPDPFHGAGHLGFTGPGLVSVPQPTWLTHSLVGRVSRPDCLLCKTRGLVDDLALSPRNGRGEDQSDQECMKCIPMVGKTGSCSCGGHNLVEEGCY

SEQ ID NO: 779552 - protein, 97 aa, Homo sapiens
FSGPQIMPVGEASTPKVARAFRLPVSASTGIPVMSHIGDPTMPYPGLSTVPSDETLLASTMPSTEAQAMPPPWLRCCPHKMPMIVGCPELSPSHCWF

SEQ ID NO: 779553 - protein, 133 aa, Homo sapiens
CQGPQAASTSPKATGLGKADVLLGWLPGTSDSRKGDLLFPTLLRNHLILPQMNHLPEPQILLQEYGGHLVMGTILFSSFLPTLNTLRLNCRFSVILPSQVKAMKETSLLHQPKHLPICWLHEPQVGGVCVKKQ

SEQ ID NO: 779554 - protein, 180 aa, Homo sapiens
QPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYI

SEQ ID NO: 779555 - protein, 53 aa, Homo sapiens
TVTKTEEGADREKRQETEKERRWRKEKEFRHTFVCVRVSAHECLEKRQGDEER

SEQ ID NO: 779556 - protein, 38 aa, Homo sapiens
MVVMVVAVIVMVMVAERVVTVMSVVMVVVMVMVMVVVV

SEQ ID NO: 779557 - protein, 49 aa, Homo sapiens
MSRLSLIILLRMSGASVLCALGLHTGGATNSHCPGLLVDSPRHRCRNLP

SEQ ID NO: 779558 - protein, 66 aa, Homo sapiens
KCEFNGGRCTRVLTSPGNSTSRRKRGHTKQDDGAIKRYSHNSKKQRAFTPPMPTPSTTNAKNFRIS

SEQ ID NO: 779559 - protein, 196 aa, Homo sapiens
LQRDGVYRWFSELPSPQRVEFLCGLLDLCIPLELRFLGSCLEDLARKDYHSLRDSEIKANNPADLGSLTNLTDEVVRSKLLVSLALLGSEQREAAGVLYRTLTHIDSIIHNYGLQLNEGRTGDEFLLLFTMASNHPAFSFHQKQVLRQELTQIQSSLNGGGGHGGKGAPGPGGALPTCPACHKVTPRTEAPVSQCQ

SEQ ID NO: 779560 - protein, 140 aa, Homo sapiens
SRGGSQQQEWNQGGRQKAAKTGRTHTMAVWGVNLQNLDTSGRQALAHSGLQIQLCHFPVNLPGPRFPCNGDDAHCHLPSIAMRIKGVRVGQQFAPDPNPVSIQQAFATIRVHCRIPLQERLPTIHAHCSVPLHSDERTEQ

SEQ ID NO: 779561 - protein, 67 aa, Homo sapiens
GEPLGRISFELFANKFPKTAENFHALSTGEKGVGYKGSCFHRNIPGFMYQGGDFTRRNGTGGKSIYG

SEQ ID NO: 779562 - protein, 95 aa, Homo sapiens
FQTWDKTSIYYRFFKNVSEPQTRQTQRNPHQVISHSNLKLNILMLNLKTKGKENNPESSKTERTSYLQGTNNSSDSKFLIGIMEAKEGAKTFVRC

SEQ ID NO: 779563 - protein, 67 aa, Homo sapiens
QVDISETFCSSLPDKRGKPRPTITQHRDTKPHNHQRKEKAGVWGQREVSLPCSPGMEPEKGQLMRPG

SEQ ID NO: 779564 - protein, 120 aa, Homo sapiens
MSSPALLLGNWTQMLILTCRLTSSSVVECRAAQALQCTWYIPNHLLKPRMPVEQALSCYLRLTSTLPSDGSGKTGDTGRIQWIKFNKAVKVHYTGQDAVSDAFNPSTLGGQRGRIMRSGV

SEQ ID NO: 779565 - protein, 123 aa, Homo sapiens
RGGCPARFAERTFTCRSYEPTNDTKHLPGRPGVVEAPQPPQPPRNDASQGSKGYNDDQGRCSRYLQVVESGYRLEAGSCKMCEKCCAGSAHGIRRAGFGRLQMTCFLSDPGLLSDTCRIVNPK

SEQ ID NO: 779566 - protein, 35 aa, Homo sapiens
IAVIIPKSKPPFALPMFLGSPMPDAEIAFMDKEGA

SEQ ID NO: 779567 - protein, 94 aa, Homo sapiens
SGITDMSQLSLLVRAVVKLLQPLPHFWEAFWAVAKALKDADLGAKDPHPAGLAGSLAWPPDPLLLLLDPSKQDQVTLMQGTGHGCARPCRGWVA

SEQ ID NO: 779568 - protein, 122 aa, Homo sapiens
MTTEEAMPEKAKCPTLEITKQDFFQEAKTLIAQHYEKINENKVQGTSINVFRKKHQKPKSGKYIPLEIDKKVTRDVVQEHRAALRRICFPKELSKSEHLQEPPQRISFKEPHIFSRRERCRP

SEQ ID NO: 779569 - protein, 82 aa, Homo sapiens
LEDPVCRRKEMGRIEAGSHSRRMPFSRDSRVTVHTGARMGSLPARELHLCEVLPGWDLEALRPPQRALARIKAHGPEQRVLS

SEQ ID NO: 779570 - protein, 590 aa, Homo sapiens
MRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 779571 - protein, 590 aa, Homo sapiens; identical to SEQ ID NO: 779570

SEQ ID NO: 779572 - protein, 630 aa, Homo sapiens
SLTQLPEPGAKLPAGPLEALPGFRFLLQWNRQQEGIPSCTMRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 779573 - protein, 125 aa, Homo sapiens
RRWCAKHAEGTLWGKEGDNRHVWLWAGLSLQLPCVLCSPCTGGVGSPLLQLRKWGRERLHIFSEVPKPGQWLRWGLPQIWSWHDAPAPLICNPNLRKKIEMIKASVGMPCALRAEGPRNCCSLNT

SEQ ID NO: 779574 - protein, 102 aa, Homo sapiens
VFRLPASPDDDQVRPRELWRGMGYWLGRGCGLVQEEVTWRNSHECWRRMKKMKKSCFSEREDSLHDFPTVGVMSFQAEILLTIHMEIEGSGGADSHINLICP

SEQ ID NO: 779575 - protein, 53 aa, Homo sapiens
LLQRWLGNVENLLCNRNFWILQLPPGSKGEAPKVQELGVGGEALPGLCRVAIC

SEQ ID NO: 779576 - protein, 116 aa, Homo sapiens
HSLTLTLILRAFPSPCLPQSMSGSRCILTLFAHTCTTVFTLASPPVSSLQCTHPGSGSCASCLKLPPPSGPLEAPDWWLSCVSPISSLHNSASSPHPLTASLPPGFLFLYLPWRYH

SEQ ID NO: 779577 - protein, 104 aa, Homo sapiens
LAGGRWLDFGLPSPLRVTILLWLELGCFALQIPLSRRLLPSLKEAPLSLVLCCSSPSWQVQLPSLLLNATEFPGCPLPIGPSWGHIILACLRRALDFYRWECDS

SEQ ID NO: 779578 - protein, 91 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEI

SEQ ID NO: 779579 - protein, 139 aa, Homo sapiens
DLSLLQPLPPRSKRFSCLSLPSSWDHRHVPPCPANFMFLAETGFLHVGQAGLELPTSGDLPALVSQSAGITGVSHCTQPLPPFYPCLPSYDALNTKNTIPSYGLSIHSSAWNVLSLDRQIPSTLLYPSSSHERQPLYLL

SEQ ID NO: 779580 - protein, 82 aa, Homo sapiens
SIIYIYHPCILSIIYLIYQTIIYLSVYIISLSSLSIHPYIERERERRECLVSVTTGWRAVARSRLTAASASCVQAILLPQLP

SEQ ID NO: 779581 - protein, 747 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMGREGQDTQSKPLNLLTVWDWSVQFEPKAQTLLKNPLYVEKPKLDKGQRKGMRFKHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 779582 - protein, 747 aa, Homo sapiens; identical to SEQ ID NO: 779581

SEQ ID NO: 779583 - protein, 747 aa, Homo sapiens; identical to SEQ ID NO: 779581

SEQ ID NO: 779584 - protein, 767 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMGREGQDTQSKPLNLLTVWDWSVQFEPKAQTLLKNPLYVEKPKLDKGQRKGMRFKLCLQAQNFSPTESTKERAVMHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 779585 - protein, 208 aa, Homo sapiens
PTRRPRVRDKGQRKGMRFKHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 779586 - protein, 747 aa, Homo sapiens; identical to SEQ ID NO: 779581

SEQ ID NO: 779587 - protein, 637 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 779588 - protein, 747 aa, Homo sapiens; identical to SEQ ID NO: 779581

SEQ ID NO: 779589 - protein, 747 aa, Homo sapiens; identical to SEQ ID NO: 779581

SEQ ID NO: 779590 - protein, 84 aa, Homo sapiens
PGTPAGPQGPHAAPVPARASPSTPPCKLREWAPALASPERGSHSAVGALKGSSNAAKVGAQAGEVPRASEGSDDCQHAVTSQYD

SEQ ID NO: 779591 - protein, 101 aa, Homo sapiens
MHCQSSLCLHHHEATPPPCLCILSRTTFLCVCAFVCVHVCTHACVCTCVFSFPSSSKDTSHWIGAHLLPSSHLQRPYFQLRPHSQVLGAGTGRRGREFSSS

SEQ ID NO: 779592 - protein, 164 aa, Homo sapiens
LSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQVCPP

SEQ ID NO: 779593 - protein, 144 aa, Homo sapiens
PFLSFLQHFLASQPGVEMTGLLSPLPIGGWSPGPRETCDPRCRRENFSPEGKSALRDPAPLPSSATDPERSYRMILETAHFRNHVAGVVHWIHHSRLKLTTQDKWTSQQDPDHPTRLILRRDQTAAEDDRPVLVTPEANQPTHG

SEQ ID NO: 779594 - protein, 121 aa, Homo sapiens
EAGPGKVPQDADCRLGKREPVPQAKRQARQRTVDVHRWPGWQGKRTQREGRRCQLLATPRPGRIKNVGCRTQPPLQPTAAPGRASPTVLRALPECEGSGQQGDGMWLNPSRTAWQLHLSQT

SEQ ID NO: 779595 - protein, 92 aa, Homo sapiens
LQSKQNYQAERGALHNDKGVNSARRHNPCCVAPNNRASKIHEAKIVTIARRNDESTIRDGDFNILLPEMDRSSRQKIIKDVVEISNTINNWI

SEQ ID NO: 779596 - protein, 124 aa, Homo sapiens
KTESSLPTPHQASLPSTTCPAMTGEQLSKCCRLPRMLLTGPRGWGQKEAAGGGNKDLAGDLQRTVSVRQSGWEPAWNGLEHGWEQRNRRQLVQKLLSRSLAVKGTGEGVIIGTGCGIRGGHLFE

SEQ ID NO: 779597 - protein, 85 aa, Homo sapiens
HLDHPGLQWSGSLNVAVPAPGDSEEGVWTHFLHTQPCCAPQDQDTDAVTSAGSTPTAGGSARNQENSSRQPGLSGVWGGERLMFQ

SEQ ID NO: 779598 - protein, 128 aa, Homo sapiens
MASFSTAETLCHNNSHSPLIPTRRGNQIKAESSGGSRAGGDGADCSPFLLPVPLPTLAPGTCSEPQGEGDISSVTHWLLLLRERERRGGPCESYASCSPAKPAKAQPGFDGIVSAGTPSLLRLVQTLL

SEQ ID NO: 779599 - protein, 83 aa, Homo sapiens
RTTFPKLTDVNLQIEKAHTGWTQWLTPVIPAFWEPVAGGSPEVWNLRPAFLTSSLASRLCPVSYRQPPVCTVYKERPCGRSHL

SEQ ID NO: 779600 - protein, 206 aa, Homo sapiens
RRFAPAATAFCRCRRRFLPPPPRLFAAATFCPGRRRFLSPRLFAPATEDFCPRRHGSEGRSGRLGCQLYWRPGKGSAEGCSWSSSPGSGILCLGAGAPGSLPGPCGLHRVALPVEAVGEKKEGGGGGDAAATEGGTGAAASRALQQCGQLQKLIVIFIGSLCGLCTKCAVSNDLTQQEIQTLELGDDILIYEMQEDVMCGTSMKTD

SEQ ID NO: 779601 - protein, 67 aa, Homo sapiens
SGTPSSGAVSAASPAWAWAPGAVAGAVACAVSRHLSLPWEAPTASSKNNTWGGAGSTSQAWPGNLGL

SEQ ID NO: 779602 - protein, 135 aa, Homo sapiens
LQQRAAAAAEAEAEAAAEPGKRGRRREPGAAMARWPAPPPPPPPPPPLAAPPPPGASAKGPPARKLLFMCTLSLSVTYLCYSLLGGSGSLQFPLALQESPGAAAEPPPSPPPPSLLPTPVRLGAPSQPPAPPPLD

SEQ ID NO: 779603 - protein, 40 aa, Homo sapiens
SLVVRGFLGWTPPSLHLRHCKMLASVGQPAPLLSPPPSWA

SEQ ID NO: 779604 - protein, 101 aa, Homo sapiens
LCAAGAAREGCSRKARALIRPSLPKPRRKRGRALSHRCLRGGSGGSRPAGCGFGECPLLRFAPTVNTARAPKVAGSPFARRPAPTGMPANTPAAICIFSHP

SEQ ID NO: 779605 - protein, 72 aa, Homo sapiens
MRKTEAQGTFPRPRAENAAELKFKSSLSDPPNPTLSPRPAMAHIPGGPVTILHLGIFMPPVGLLSGALITEG

SEQ ID NO: 779606 - protein, 108 aa, Homo sapiens
PESRAEPRVFLKTLGVGHGGEVVPRGPRGARHGRRDSGRSVRRTVASASRMCRSCPGRPGSPRCGPGLAPDSLSGPCIGQHLSVQYLEHASSNGFCFPFPAPFATHGP

SEQ ID NO: 779607 - protein, 108 aa, Homo sapiens; identical to SEQ ID NO: 779606

SEQ ID NO: 779608 - protein, 83 aa, Homo sapiens
QMICSLCGSRSCLPPGLLLLHVGEVDLREVADDLQPLRVQLLLAAVPVAAVLLAQLAVVEELREEPVEEEDGKLACEEASCRN

SEQ ID NO: 779609 - protein, 83 aa, Homo sapiens; identical to SEQ ID NO: 779608

SEQ ID NO: 779610 - protein, 112 aa, Homo sapiens [sequence omitted]

SEQ ID NO: 779611 - protein, 40 aa, Homo sapiens
DSSGGAPGVIVVDWLSLSWVILGGRIEHGRRTTGVGSECV

SEQ ID NO: 779612 - protein, 69 aa, Homo sapiens
RPRKNPQALVLSGVKERQGDVESGRSFILSPGASRRGWAGPAGSCLLDLPVGLRVALVGQDVVPAKGAL

SEQ ID NO: 779613 - protein, 46 aa, Homo sapiens
MEEETKAERSSDNSHPYPRLTKLISGSSGVQMHVAGSSKCPNCCVM

SEQ ID NO: 779614 - protein, 199 aa, Homo sapiens
MGNLCCCIQGDSKNSSKKRVKREPYSTTKVTSGSTFNENTRRYAVHTNQCRRPHGSPVKKKMYPQEDDFHHTIFSNLERLDKLQPTLEASEESLVHKDRGDGERPVNVRVVQVAPLRRESIAPHGDTIHDITNEDAVHDTTDEDAVHGTADEDAVQGIADEDAVHGIADWDAIQGLADRDAVHGFADGDAVKGIADGDA

SEQ ID NO: 779615 - protein, 60 aa, Homo sapiens
MKHAGLGEGIPPDNSGNDGYANNGYSAREEENETLTENLRSKVTAIKSFSIEIGHEVKTQ

SEQ ID NO: 779616 - protein, 58 aa, Homo sapiens
MLVVFAPCRWGPKRYMFMATTARTRRMKSSPQTKSSGWTAGYVGGQEVHQEVDQVHQR

SEQ ID NO: 779617 - protein, 107 aa, Homo sapiens [sequence omitted]

SEQ ID NO: 779618 - protein, 113 aa, Homo sapiens
MWPLRLVSLVWSCGRAAPRNRLCSRPGTYSSCSYFLYLGNSRSGRSCCCGVATSEKSPRPSDCSLIACSLLWKPSPNTEKFNPIIKKGFRFSLHLYVLIKVCRSAGILIENSP

SEQ ID NO: 779619 - protein, 67 aa, Homo sapiens
EMRTPLRGASRRVESGGSAAAPLPPAAGDCNSGGCTGSSDDPARRWQCRSQTGSFQKWFLKESNVHE

SEQ ID NO: 779620 - protein, 67 aa, Homo sapiens; identical to SEQ ID NO: 779619

SEQ ID NO: 779621 - protein, 67 aa, Homo sapiens; identical to SEQ ID NO: 779619

SEQ ID NO: 779622 - protein, 103 aa, Homo sapiens
GLMLILDVRNMLKILTKAKNSRNFQNPPTRNSLQKSCTLRNKDGGRAQWLTPVIPALWEAETGRSRGQEIETILANTVKPWWQAPVVPATQEAEAGEWREPGR

SEQ ID NO: 779623 - protein, 126 aa, Homo sapiens
MLYCRPGPWLGVSVSPCSGQACGFGYHEGPSSPGGFRELPLKCMWGAGVQPCCPWPGSPGSTALVRSCPKGTGGPSTRTEAWHHVVSVFMARKHRGRLLGLEEAGGRGSKADPLAGGGHCGVPFLQ

SEQ ID NO: 779624 - protein, 169 aa, Homo sapiens
QKNHQVAKNNTTVNSKKKRKLQERKFNYSTLHSSAVNSIHEVERTAHERCRWERSMRHGGNLRSHTSSPMTGSMGAIHRATLHLPRQEAWGPSSEPHFISHDRKHGGHPLSHTSSPTTGSMGAILRATLHLPRQEAWGPSTEPHFISHNRKHGGHPPSHTLSPTTGSQC

SEQ ID NO: 779625 - protein, 223 aa, Homo sapiens
MILGNGGIALELVYEIEGCEVIWAIKDKAIGNTFFDAGAAEFLTSKLIAEKSEAKIAYKRTRYTTEGRKKEARSKSKSDNVGSALGPDWHEGLNLKGTKEFSHKIHLEAMCEVKKIYLQDEFRILKKKSFTFPRDHTSVTTNTEMWPVYVELTNEKIYGCDFIVSATGVTPNIEPFLHGNSFDLGEDGGLKVDDHMHTSLPDIYAAGDICTTSWQLSPVWQQM

SEQ ID NO: 779626 - protein, 1257 aa, Homo sapiens
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEEKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 779627 - protein, 516 aa, Homo sapiens
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEEKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKV

SEQ ID NO: 779628 - protein, 105 aa, Homo sapiens
MTTHITHIQYLMQYPAPSDCSVHRRPAPLPIASTFPLKVTGSGQVVGLQLGKLGGNRPRGENFPNLHSHPSPNAPASTRTSRRDCGLLGSRVSSTAPDSCKCVTS

SEQ ID NO: 779629 - protein, 191 aa, Homo sapiens
PSCEGKQTRHEQLPSPSLLTMWTLKSSLVLLLCLTCSYAFMFSSLRQKTSEPQGKVQYGEHFRIRQNLPEHTQGWLGSKWLWLLFVVVPFVILQCQRDSEKNKEQSPPGLRGGQLHSPLKKKRNASPNKDCAFNTLMELEVELMKFVSKVRNLKRAMATGSGSNLRLRKSEMPADPYHVTICEIWGEESSS

SEQ ID NO: 779630 - protein, 152 aa, Homo sapiens
MKLPFLVDGAFSLESSQGPTFPTDGAFSLSPHTRPTFLTDGAFSLSPHVGPAFLIDGAFSLSPHTRPAFLIDGAFSLSPHTRPAFLIDGTFSLSPHVVEGARGLSGVPFLRTIITFMRLHPQDPITSQRPHLLTPSLLGSGFGTSTLERHRR

SEQ ID NO: 779631 - protein, 70 aa, Homo sapiens
DTGTGLGALERGRVHICHHPTDATGCKRGPDEAAPALRATGVLGAQAVTSTVLAHLSSPGPTGHAQAQGG

SEQ ID NO: 779632 - protein, 108 aa, Homo sapiens
MGNELLSRAAVQNQNGLPCKDIPDLSDPAEADVIPSLLQMYTATSHPSLLPFSQPWPSIEDFSIYSLSAGCKPSPSSHFRSLSRRSSLLLHLPFSYSLLEILLKMQTL

SEQ ID NO: 779633 - protein, 127 aa, Homo sapiens
ALDRGCGGGEAGCPQTGRPTKKGMRNPLVHGPLCDGPRHRTQWPAESPPRDCPGSGRACYPRMGCLWPLGQSPIWPRLAWDGRTGTRQGVSDLTAHLGRRKEGWALPSLDGGDGQAGRCLMHPADPN

SEQ ID NO: 779634 - protein, 50 aa, Homo sapiens
MVWEETALSLKPCLSVVSDAQLHVFLMLSSLYPRPLASAAEVALFLPFVL

SEQ ID NO: 779635 - protein, 108 aa, Homo sapiens [sequence omitted]

SEQ ID NO: 779636 - protein, 109 aa, Homo sapiens
EGQDQGLWGPLGAWLVAWWPGGMLAGTDSPSGWGCIPCGHVWMAVCLHLRHSSLTPHPCHGSSRQNHSHLLSVCYGRHSTWPLYMHSLGTAMGCLSPGFVLFITVLSPT

SEQ ID NO: 779637 - protein, 89 aa, Homo sapiens
PASVPLPGLPGVLASPLGPEPCRSDVGAGAAGAEDAGEVSGSRATCGGLGRTPPGRAGRRQRGGAGLLAPHEWGRCLSATTSRLAAGLT

SEQ ID NO: 779638 - protein, 75 aa, Homo sapiens
RGRSGAVRAWLGRLETVALNGPPPVGGKAAGLESQQATCEEAGSPGGLDTAMWTSPLPQRCWLLIACTSLPKKRN

SEQ ID NO: 779639 - protein, 34 aa, Homo sapiens
MGGSAKHTWTLSLMGGKLCNLPGGRSQCLIVHST

SEQ ID NO: 779640 - protein, 66 aa, Homo sapiens
VPITLLDGRGDLLGFSGGELCLVESRSLQKVLQPAHPDQDLACWPSLFTFLISSCAVLKTHAGTGP

SEQ ID NO: 779641 - protein, 73 aa, Homo sapiens
KGGANSIAATMDVGVTEKLQGELNLGAGNSKNGVAIYYDGEDYEKGRYGGERYRIRFFKPKFEMSIQEELPTH

SEQ ID NO: 779642 - protein, 190 aa, Homo sapiens
APHFLLSQQHLPSAPPPLSTIQTAPAECPPLSTIPTAPAECPPLSTIQTAPAECPPLSITTAPAECPPLSTIPTAPAECPPLSAIQTAPAECPPLSTIPTVPAECPPLSAIQRAPAECPHSLLSRQHLPSAPHFLLSRQHLPSAPHFLLSRQHLPSVPHFLLSRQHLLGNSPSAVVCVPARALGLVWGSR

SEQ ID NO: 779643 - protein, 118 aa, Homo sapiens
MKQTVEDCCLSAPFVAGQGILLERVSETTLKFIWNQKRAHIAKSILSQKNKAGGITLPDFKLYYKAIVTKTAWYWYQNRDIDQWNRTEPSEIMPHIYNYLIFDKPEKNKKWGKDSLFN

SEQ ID NO: 779644 - protein, 142 aa, Homo sapiens
GRLGPGRVTGPGVSWVPVGRRGWAGFRGGREGPGAQDWDRGADLGPCRGSASGRPELGWPFRRTGSSPLAAPDAPGKKPQLFQSQLQTYSRPHVELKWEKTLKEAVKDAGGHVREEQKEDNGKRSSYPENIPGPLQAVGKIW

SEQ ID NO: 779645 - protein, 114 aa, Homo sapiens [sequence omitted]

SEQ ID NO: 779646 - protein, 43 aa, Homo sapiens
HHGVKSWSRGIHQGLPKATVCMPTCLIPPTCLALAPGGRQHYL

SEQ ID NO: 779647 - protein, 69 aa, Homo sapiens
RSVEQRTGIDCSDDGKKSEYNTNHISEINYMCSRNLTSQIKSTEYHSSKKVTLREHSTKNYGKKQTTSA

SEQ ID NO: 779648 - protein, 73 aa, Homo sapiens
TYSVPGDGESLLDRPDKVPAPVKLWILERDRDSDDKDMETKQSATSTVKENKQDAVTENLGDCLGFLGHLRSW

SEQ ID NO: 779649 - protein, 361 aa, Homo sapiens
RSGTASACALACQRRWTMEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 779650 - protein, 214 aa, Homo sapiens
RSGTASACALACQRRWTMEAARPFAREWRAQSLPLAVGGVLKLRLCELWLLLLGSSLNARFLPDEEDVDFINEYVNLHNELRGDVIPRGSNLRFMTWDVALSRTARAWGKNVCLRIIFIYKMYKWSILNFMVLVKICGSALKMNLLQVLLSEVGMQRRKCTILKMAVALETVLIIFSLFGTTLTKLVVLLLHVQKLDILYMQQFSYATMRQEEH

SEQ ID NO: 779651 - protein, 270 aa, Homo sapiens
RSGTASACALACQRRWTMEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSKIKKINMKKMHNGLDKKNKRLNTSFLWSC

SEQ ID NO: 779652 - protein, 122 aa, Homo sapiens
FDIYFQGNLNQKEGNESQASFYIPVSRDKREFLLHSFNAVPSLSRLPVASLIPGPYFGPVWPHEFDYICMKVFTKNSTFLRLYYILHMLLTHIFTTFPREGKKLWAWERWQLRIEIVLYLVH

SEQ ID NO: 779653 - protein, 92 aa, Homo sapiens
ACQLKPQPRALATVLVGHPCPSCSMASICSAPYTTPEVGEPTTEPLTKKVLTMEKLRYWRRGLCSHAGSRAPVSQAAAATKGAQGLACWSQC

SEQ ID NO: 779654 - protein, 108 aa, Homo sapiens
KKQICKWAMDSNRHLAIEGIQLVKRHMERCSASLIIRKMKMKTATSGLDHSGMHESFQTSSCWEWLRRLGSFCLSWKSGVSTRTSVFWTCVRPGVFMAGCLVYLCLTE

SEQ ID NO: 779655 - protein, 70 aa, Homo sapiens
KRLEVGLEEQQVGLPGPSSVLSTASPGAKLPRVSLSRPSSPASRNTGDKPLLSIYHLSETEPGTGEVKTS

SEQ ID NO: 779656 - protein, 169 aa, Homo sapiens
GRSHFRLGNMAERPGPPGGAVSATAYPDTPAEFPPHLQAGAMRRRFWGVFNCLCAGAFGALAAASAKLAFGSEVVSMGLCVLGIIVMASTNSLMWTFFSRGLSFSMSSAIASVTVTFSNILSSAFLGYVLYGECQEVLWWGGVFLILCGLTLIHRKLPPTWKPLPHKQQ

SEQ ID NO: 779657 - protein, 135 aa, Homo sapiens
AAAPTSDWATWPRGRGLRAAPCPRPRTLTPPRNSLRTSRRVSMGLCVLGIIVMASTNSLMWTFFSRGLSFSMSSAIASVTVTFSNILSSAFLGYVLYGECQEVLWWGGVFLILCGLTLIHRKLPPTWKPLPHKQQ

SEQ ID NO: 779658 - protein, 169 aa, Homo sapiens; identical to SEQ ID NO: 779656

SEQ ID NO: 779659 - protein, 74 aa, Homo sapiens
GRSHFRLGNMAERPGPPGGAVSATAYPDTPAEFPPHLQAGAMRRRFWGVFNCLCAGAFGALAAASAKLAFGSEV

SEQ ID NO: 779660 - protein, 72 aa, Homo sapiens
VQLSVSMHRVLVLPALSLRDLGAATPKAASTLSTQISSTRNQGSWEKWPIAELKQGQYKRKLERLMCWKVRS

SEQ ID NO: 779661 - protein, 238 aa, Homo sapiens
NFTGKSHKSQSSMAHKGEIHDPPPEAVQTVTPVEVHIGTWFTTTPEGNRIGTKGLERIADLTPLLSFQATDPVNGTVMTTREDKVVIVERKDGTRIVDHADGTRITTFYQVYEDQIILPDDQETTEGPRTVTRQVKCMRVESSRYATVIANCEDSSCCATFGDGTTIIAKPQGTYQVLPPNTGSLYIDKDCSAVYCHESSSNIYYPFQKREQLRAGRYIMRHTSEVICEVLDPEGNTF

SEQ ID NO: 779662 - protein, 72 aa, Homo sapiens
ESLCFEASVLWLVPTSPDYFQTLPAAILHYHLLSVFSDLQNTEVFSLSGSSHLLFSLLKILLLQAGRGGSRL

SEQ ID NO: 779663 - protein, 129 aa, Homo sapiens
GAYYYRAGRVWPFLLILNNFKLIQNIAKIKIGQRTQFKHFSLHLRPFTSRHISVYFLRMRMFSCVPQDTCPLLALFRKCLPSPVLEHVLPRYSCVRMFLRGHDSQVSANGIGSEQQETGHVAWFVGWVE

SEQ ID NO: 779664 - protein, 120 aa, Homo sapiens
PGGANSQEVWDQEYESCPTGLRRKKRFEAAAWHKLTGHYPPWSISVRPFLTGFGAQLSLSHSLAQWLSFLQVLPGSLLPPPSAKGRRVCFSPLLTRSLLSRPYQVSDQSEAGTGGIVGPG

SEQ ID NO: 779665 - protein, 112 aa, Homo sapiens
MPSAPGTRPGPLSCSHRIPHGTDPERPLHTLGRASSAFCSVKAGHGAWRPHLQQPQSKGLQLPPQNPLGSAPTDLGWREGGGEAGREASPSPVSLGAGEAESSSLPQAETHH

SEQ ID NO: 779666 - protein, 108 aa, Homo sapiens
RPNPATHSPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILR

SEQ ID NO: 779667 - protein, 138 aa, Homo sapiens
MDPGLKPRSHGTLSNPSPPHAPGSCFQLDSPSRVTLLQTQELLLSLPLPSDQIWRALKEFMCRLSLNLNTEHTHLWPHGAHIPNQCDKEPTISRPPCGAERRLTRGCEPGKSTHHRLGPKFPIKGDLESQEIQCQGSL

SEQ ID NO: 779668 - protein, 142 aa, Homo sapiens
CSRQTGLTNTTTATSLTTVDPHVPGSTTILVRFCSPFIPSLSQTTPSLLRLPNLLLAHLRYSTEKIRTIRKEFQLPPNPPPSPGLPFVTGDELVEFLSKTTAPLLTRSQGLKDIAQQFSPFSPHHFASHQDHPMSTDMLSFP

SEQ ID NO: 779669 - protein, 101 aa, Homo sapiens
AGVGRAAGPALWGWPHVWAAVRVCRCVWTSCVCGCVMCLCGLGPYHAPTSSTELGSCPHAFPASQASLGAVLHLPSRTGLLSPRLPSVPGQPGGRAPPPLP

SEQ ID NO: 779670 - protein, 209 aa, Homo sapiens
PKRLGPAMGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLS

SEQ ID NO: 779671 - protein, 41 aa, Homo sapiens
RVLVCVCVHVCVCVRAHAAPPGGHSAHCARHRAGLCFWLRK

SEQ ID NO: 779672 - protein, 74 aa, Homo sapiens
MHLEFTPTSPSPLTWAATASYLGSLLPQLPLSSFTGHRAASDLLLASHTLTTALQPAPSSSAWQRPHPSGLGFN

SEQ ID NO: 779673 - protein, 89 aa, Homo sapiens
ARIWSQLNDGPQLNDGPQLNDGPQLNDGPQLNHGPCSCCERWFLDLSPSCLLLLEGPPFVKLRFCENPANFCPNLLHTEAAFEDRCEGS

SEQ ID NO: 779674 - protein, 101 aa, Homo sapiens
SEDPPYVLTHRISNPSCLRTQKQVSVWPTSGNGWSSLPGPSPCLVLMSIEGTWEMRPTDSKLLSFPLLWASEIESLSIFWCGREDLSLRARARYSLPSQNL

SEQ ID NO: 779675 - protein, 218 aa, Homo sapiens
REATIRNRCMSDGQPEGQTELRKGLEEPHTCGRPTAPGTRPAEVDVLSPASDKGGLQSFLLDPAHAEARAELSNETDTSFAERSFYLNYEEKDSEDQVLPPPLEERKGRLDAPPGGEPRPTLNSLDLRVSAAASSRSKDEAHMTSPKEGAGTPKNHGGPGDLKGSPAGQTFAEGWEDAQWGVEGEFPHLTASAAREEGTPVSGDLLGKAEESPTEELK

SEQ ID NO: 779676 - protein, 37 aa, Homo sapiens
QSRPVLEAECTQGSYAPIAGVRGPGQHEPGEWPRASG

SEQ ID NO: 779677 - protein, 37 aa, Homo sapiens
SHRVLFIPLVKQEYNLLNKAVLLGVRPPGFDALNHSP

SEQ ID NO: 779678 - protein, 43 aa, Homo sapiens
EVYSDLCSSKFGSRKQRTPGTAHAYRLLGEHPRQRRRLQKSSL

SEQ ID NO: 779679 - protein, 110 aa, Homo sapiens
SISPSHKFTFQIILCLPTYARTSSQHRPNMGHTSPQHIHILPKPNSSARPGSRGIPGHVTVSSTNLWIYLLYFKSWISHKRCQPYSLHTFQIHRQEKPLGFLQRNFSRSE

SEQ ID NO: 779680 - protein, 84 aa, Homo sapiens
QGNIQSQPEFIRCQRRNSYRFLNRHLQPRPERAEHSLELLETQRETILLSLSAGASCRTSGPSSCRKRDYSHVYIIPVELQKLG

SEQ ID NO: 779681 - protein, 96 aa, Homo sapiens
SWGVGSRVERRHPPWERASTWPEMQMDASDGLLSAHHTVPSQGLPQPGGGAGSRIYSSCYVVEGNGDEGGPGLPTILPCTIKTFCTQKGCPNGPSA

SEQ ID NO: 779682 - protein, 123 aa, Homo sapiens
SDLCMPCTGTKCLQDPLRVLLPLGGGAGPVVFLCLGILLMFPTWSSAFPTAPGSQGQGPWTCLLLLTSLCFMGRDETQARVCQLTTFQPALFSCLPIFIIWQVLSFCQCLRADRRAFPCTNQE

SEQ ID NO: 779683 - protein, 84 aa, Homo sapiens
SRAYCIAAAEETQALEQATTAQRGTCQAATSTGGCERIEREGVAALCVVCVPAQNIHFLLATDAPRLLSRGEIKSSLSFNKVIP

SEQ ID NO: 779684 - protein, 332 aa, Homo sapiens
AWGTKTTTASERSGFAEGPRRLLPPYHSLINNFVKPEKLTKVETRLKEKIVAEMTDLNKHIKQAQTQRKQLLEESRELHREKLLVQAENRFFLEYLTNKTEEYTEQPEKVWNSYLQKSGELNEEDKNQPSRYAEQISVLKTALLQKENIQSSLKRKLQAMRDIAILKEKQEKEIQTLQEETKKVQAETASKTREVQAQLLQEKRLLEKQLSEPDRSYWEKRKRRELNMKAQALKLAAKRFIFEYSCGINRENQQFKKELLQLIEQAQKLTATQSHLENRKQQLQQEQWYLESLIRARQRLQGSHNQCLNRMFQRPHPVFPKAPNQGLIQSNF

SEQ ID NO: 779685 - protein, 105 aa, Homo sapiens
CVLICSYENPSQTWLEPTLMTSFHLSGLLKGPVSMHSHILEYWGLGLQHMNLDNSVHNRGAGPRAALWLAQPSVSMLLLGSWNWKGHEECSSPNPPTCTKGETKV

SEQ ID NO: 779686 - protein, 593 aa, Homo sapiens
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNPKKKMKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 779687 - protein, 243 aa, Homo sapiens
MSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 779688 - protein, 328 aa, Homo sapiens
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGLWMESLRTTGLEASGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNPKKKMKKKKYVNSGTDPDQLHCGH

SEQ ID NO: 779689 - protein, 243 aa, Homo sapiens; identical to SEQ ID NO: 779687

SEQ ID NO: 779690 - protein, 243 aa, Homo sapiens; identical to SEQ ID NO: 779687

SEQ ID NO: 779691 - protein, 315 aa, Homo sapiens
MKKKKYVNSGTVTLLSFAVESECTFLDYIKGGVSVSSSVHKENWNRTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 779692 - protein, 524 aa, Homo sapiens
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGLWMESLRTTGLEASGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNPKKKMKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLMLPLHVCSCLPTAGPGFLVPDKTQNGNQENPSCCGIDGILEAYHRSLRTVQLYGPTNFAPVVTHVARNAAAVQDGSQYSVLLIITDGVISDMAQTKEAIVNVSKECAV

SEQ ID NO: 779693 - protein, 238 aa, Homo sapiens
MKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQVKPRPCLPH

SEQ ID NO: 779694 - protein, 243 aa, Homo sapiens; identical to SEQ ID NO: 779687

SEQ ID NO: 779695 - protein, 301 aa, Homo sapiens
MKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 779696 - protein, 426 aa, Homo sapiens
SAGHPRARALGSSLTCRAGSHTQSPQTLNKQSSSLPSTLPGPEIQGSTTLPPPRSSTPGKSTVQLHAELMPLLQWPRRRTIKVEVYDWDRDGSHDFIGEFTTSYRELARGQSQFNIYEVVNPKKKMKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 779697 - protein, 328 aa, Homo sapiens; identical to SEQ ID NO: 779688

SEQ ID NO: 779698 - protein, 140 aa, Homo sapiens
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTEKLLL

SEQ ID NO: 779699 - protein, 200 aa, Homo sapiens
MKQELQNLRDEIKQLGREIRLQLKAIEHQEPRPGFSPSSLGGRAEPPVGPLPHTGPYAEGQTVLLGLAAAHFMMASSFRPQCLGEACTVLIGRDTRFCTKINTKHQNKKKKKNLWAVQGLKKTFKTNSFMGEGGPKRRTGKPGDKVVSQERPVDTQNSEWRFHSKKKTARGEQPRFVTTTEREDPGLTGDSTTGDKRIDK

SEQ ID NO: 779700 - protein, 39 aa, Homo sapiens
MGFTQELTEKSNSGYPRRRSCSGIKRVCMEFALRAYMEQ

SEQ ID NO: 779701 - protein, 117 aa, Homo sapiens
HGSPWVSHTGKTNSAGTAETLFPTVISIAAQKILWMEGPAATYPPDGSTEYIGLRLESSPIAHCPAPGLTNAQDRLEMDRKSTAPSFPQLATWVGISSSREFDLADTMLLLYHFFAT

SEQ ID NO: 779702 - protein, 77 aa, Homo sapiens
SIPQESWRQQPSVPSPRSATHRCHVSTQLTPAQSWIDSSAQGFGDYNHPAGVLLSTSSGFLCSFVRRDFSGSRALGP

SEQ ID NO: 779703 - protein, 51 aa, Homo sapiens
QAIGIEDARFRSDCSPLRGTITSIYQFSKTTTYVKFNSPNTLHLHPPADIG

SEQ ID NO: 779704 - protein, 107 aa, Homo sapiens
MDLKLYKVKTEFSTPLSPAPIHFSPVSSISNCGTAAHSSCCLSQISRDYLRFSFFSFPLLNKLSVHFINFYLPKHNPNIFTCLHVYYQHPALNHCYSFLHFQLCPLQ

SEQ ID NO: 779705 - protein, 105 aa, Homo sapiens [sequence omitted]

SEQ ID NO: 779706 - protein, 134 aa, Homo sapiens
VVLGAAPATRARVSAARTLQGQVATLRDATWRSGLGCVGQGPGPDTGAAGMPGALRGCGPRAVRGSELLAGRGARQRTERSPGRRLIIAEDQGLEELLDLEVQSRCLESILAVLAEKMLEHHRLVGQGPGKVLL

SEQ ID NO: 779707 - protein, 90 aa, Homo sapiens
VVLGAAPATRARVSAARTLQGQVATLRDATWRSGLGCVGQGPGPDTGAAGMPGALRGCGPRAVRGSELLAGRGARQSYPGSYLWYQCDPS

SEQ ID NO: 779708 - protein, 149 aa, Homo sapiens
SISEPPLKKIIYGITILMIVQQSNHAIWIHVFTSKELVAFAISKDVQPLSKRFYFFWSLFFKFAFDCFHVIFDVVLVGVFCEAGFLQVIVCDSINSDNCGFGTFALGTFSRGISANEQVISVTLCPTDHIPLHHQAQPICNLPNLINVE

SEQ ID NO: 779709 - protein, 127 aa, Homo sapiens
PHRLSKGLQPKFLAPPPEIAQKKVTNGEENRILRRLLRRYRESKKIDRHTYHSLYLKVKGNVFKDKRILMEHIHKLKADKARKKLLADQAEARRSKTKEAGKRPEERLQAKKEEIIKTLSKEEEAKK

SEQ ID NO: 779710 - protein, 92 aa, Homo sapiens
TSSSLPTTETATTPMTNLVTTTTEISSHSTPSFSSSTIYSTVSTSTTAISSLPPTSGTMVTSTTMTPSSLSTDIPFTTPTTITHHSVGSTVS

SEQ ID NO: 779711 - protein, 93 aa, Homo sapiens
TSSSLPTTETATTPMTNLVTTTTEISSHSTPSFSSSTIYSTVSTSTTAISSLPPTSGTMVTSTTMTPSSLKHSKHRLLNHTVIFSTTLSAGGS

SEQ ID NO: 779712 - protein, 485 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQVCQGLFNELLENGISVWPGYLETMQSSLEQLYSKYDEMSILFTVLVTETTLENGLIHLRSRDTTMKEMMHISKLKDFLIKYISSAKNV

SEQ ID NO: 779713 - protein, 398 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQV

SEQ ID NO: 779714 - protein, 328 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHLKVVI

SEQ ID NO: 779715 - protein, 485 aa, Homo sapiens; identical to SEQ ID NO: 779712

SEQ ID NO: 779716 - protein, 485 aa, Homo sapiens; identical to SEQ ID NO: 779712

SEQ ID NO: 779717 - protein, 330 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHMQRHSPT

SEQ ID NO: 779718 - protein, 58 aa, Homo sapiens
PLYVKHRAPHFENHHPRRFLIKFGDSPKQNGSLRGLATEGTWFVLGGQSRLIVFLLCC

SEQ ID NO: 779719 - protein, 102 aa, Homo sapiens
PHSAQASICVPAPNPRLHPGWCLEGLPASACLLQPGGSELHMFLQGALWNRTQPGKEMRLTRASAWMSLEDVTFSERRQTPKATQGRFDPISMQCPGRRRGH

SEQ ID NO: 779720 - protein, 70 aa, Homo sapiens
GAYSHDHNIDECLTFLEVLNTPLFFLIYLHLMTGQVRGSSVLCHPNTGIQKEGGTVKIPIAIEKRKKHAE

SEQ ID NO: 779721 - protein, 118 aa, Homo sapiens
MKLPRKHNNWLVFPHETLEVCSLLIVRSAQAAEPIAVTQVCTLAKEKMATLYTDSRYAFGVCHTVGIIWKCLEFLTSAGASIANGHIIVDLLQAIFLPTKITVAYCSAHTKESGIVSL

SEQ ID NO: 779722 - protein, 137 aa, Homo sapiens
SFPSPGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRVVLINNNLGWPNGLTVDKASSQ

SEQ ID NO: 779723 - protein, 48 aa, Homo sapiens
MAAWRSTGRSEATCETDATGPGHSQKQRQGTNTKCGFSGLHKSSKQST

SEQ ID NO: 779724 - protein, 71 aa, Homo sapiens
MWTYVIEGFLEAQIPMARQVLEPELLYLWLASQAIQCEKTSHSHQDHPLGAGWAVTPVSPGFSPPPTSSRA

SEQ ID NO: 779725 - protein, 169 aa, Homo sapiens
MRCTSHPATITGPAHTGRGPVRPTCLSHGVTSWRELRKLADGRWWPSMLGVLACCVHGPAVHVTQQAQGLDPGEVPFDRCGSGPLVTKLSLVWTGSSANVAVRVTPTVASHVSHLVDGFQLGALVRPLQLAPRILSPRIRTSWGLLGRDTLLHKPLQPRGLTLAVWSGR

SEQ ID NO: 779726 - protein, 116 aa, Homo sapiens
ICTCRGFSSPHLPQLFLPTHCTFQGNPSLGSARIVRCTPCVIIPGNFNRILSSFLSKFGGNLVWCDRKSPEFSVVDHINFMCQSLRLRLASLKEGNNGLLGFTPLFPPNFHMGIWL

SEQ ID NO: 779727 - protein, 73 aa, Homo sapiens
RPQVTPPCCLGSLALRQPCAEALEWDVPLGEGDMGARPCARRFPLAPTTGRKAGWGLRLRGSLHECGRDWPGP

SEQ ID NO: 779728 - protein, 57 aa, Homo sapiens
MYSLILVRPKPVAWSGLCELGSTLAKSNPFDSSEIGVGWRRSSYPFINPKACCYWLF

SEQ ID NO: 779729 - protein, 146 aa, Homo sapiens
VCTIHTHPKWCGLEPSRLASGLKAERPWGFFSFLGQDSPFVGTTSSINLTIAVSLVLTVSRHCDQHISQPQNHPLELFLVRDGTNHLCVARPAGAALGGGHAGAALVASWHCRLAWHSLGAQVFLGKAGPGVRSWASIRGGCQMLS

SEQ ID NO: 779730 - protein, 221 aa, Homo sapiens
WSAAAGLRAGVRVPRSPGPSRRMPARSGAQFADGWGKRSSDQLEQGSHTARPTQPRHLQSSHTARPMQPRHLAPGSAAGTATIRAHTAASISQAQRATLPDWGGVLRPAGSPPGPGISGTGPSRAIPNGTELRGRIVETEAYLGPEDEAATQGVAADPRNRGMFMKLGTLYVSIIYGMYFCMNISRQGDGARVLLEQLEPLEGPETIASASKTPRKDRSRV

SEQ ID NO: 779731 - protein, 47 aa, Homo sapiens
MLGLEGKVEFTSMQGGSTTLADGTALAKVQRQEALHVKGYIFRTLNI

SEQ ID NO: 779732 - protein, 102 aa, Homo sapiens
LMKQCNMCVKCKVFMLGQLARPPCCAIFRKAAQPGEQGLAAVLPHSLGLSAACPSGVRCTSLPGVHPDLGRSVHLLNLVIWKGIQPWIFMEVPFSGCCWLQM

SEQ ID NO: 779733 - protein, 85 aa, Homo sapiens
PSFAGWQGSGALPCLPAQAAERERFHLCCEREEPLCAPRHVQRAGGNTLSCGGQLSQGPCLTRARRLPRGPRMAPGRQTPIPVES

SEQ ID NO: 779734 - protein, 117 aa, Homo sapiens
MDLKQAGLSSVGPHCDCRGTLQCGCTVHVGCGISGAAGKSPGGSCIGWVSGWASSRNGGCGTGNCQGDSPASGGRKSSLDPEWMPRQPKTMSVPCTLWRLISSFPFLCKLHWIFKFS

SEQ ID NO: 779735 - protein, 76 aa, Homo sapiens
GPGTPHSLPRPQAPAGAEPQAGLQCTALPGGRGMDTHTQWPPTTHKSRECGSCRGPPHPAPLGTSGCARMFERVWT

SEQ ID NO: 779736 - protein, 164 aa, Homo sapiens
MASARGAKQSSPRVGTTPYTETSTVRVETSSHRVETSSRRVETSQRRSEGPSLSPSGKRLPRILEASSRHVESSSQRTETTSRHVRASSLRVETSLHCAESPTPRPSRPPARTKKRPDEMLLPKGHQGARALSQDRKASSCQPASQLPGGPIIFGFMETNHKSM

SEQ ID NO: 779737 - protein, 45 aa, Homo sapiens
NYRASSSKRRKTHLQTLPKDQGTDSNSNFPKHFSLHRLRFTTNSS

SEQ ID NO: 779738 - protein, 121 aa, Homo sapiens
AERSVNSSGARANIGLAAAACQPARGVLGPARCTPTGTMASSQGKNELKLADWMATLPESMHSIPLTNLAIPGSHDSFSFYIDEASPVGPEQPETVQNFVSVFGTVAKKLMRKWLATQTMN

SEQ ID NO: 779739 - protein, 145 aa, Homo sapiens
VKFIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTFTTSSSSTQSGG

SEQ ID NO: 779740 - protein, 112 aa, Homo sapiens
MKSFLLVVNALALTLPFLAVEVQNQKQPACHENDERPFYQKTAPYVPMYYVPNSYPYYGTNLYQRRPAIAINNPCVPRTYYANPAVVRPHAQIPQRQYLPNSAPPLWYVAQT

SEQ ID NO: 779741 - protein, 125 aa, Homo sapiens
MSCLPPQGVFFPISELSKCTIGFYTETFRSQGQAGDRGLPLISTARGLPLLLILLSTDPLWVSGWGTVRTFSSQEAIFQTITGGEKPWTIPGFPRQRSQQLFAVRCAPGLLRLENGDDFYQAYCL

SEQ ID NO: 779742 - protein, 110 aa, Homo sapiens
RVNPGGNPGCGRRLRPAGAEGKNGALRKRGASPSRFAAAEPARPRGRGEKPETGQRPGEREDLAMLPRLDLTSWAQGILLPQPPTQQGLQLHTTTQLPSSCLTCPYYHSE

SEQ ID NO: 779743 - protein, 108 aa, Homo sapiens
RPSSRPRLSLHTSLQAEGAGSGLCQPRNGLPQCSSRLKGSSSVARVGAEAEEAPRASEAASTLSPLAASDSGVAGITVTRHHARLIFVLLIETRFRHVGQACLNLLTS

SEQ ID NO: 779744 - protein, 130 aa, Homo sapiens
SSSSSISSSSSPSSNFSNFISSFFSFSSNSLNSSSSFPSPAFLIPPLPSTFPPPPSPPPLSILPNPPPPTPPISPSPVPLSPIIPPPHAALPPVTPLPHTLLLVTPPPPLVPLPPITPPPHAPLPPITPP

SEQ ID NO: 779745 - protein, 115 aa, Homo sapiens
LNLLSLAVMSLSARDRSPSSRTLSSLAPGASTSTSMLGRDTSTTGVITSALGPFRSSLGPLTSTWGPLRATLGIFKQGICTLGRCPLRPAPLGRGPSGSFTSTWPAWTSRSAEGD

SEQ ID NO: 779746 - protein, 69 aa, Homo sapiens
SSHPLRGGIVGSRRICTSETLIHPWQDGEPFAVLSGYSPKWLPGRVDLCFFPRVRFYNTWASGLGTALH

SEQ ID NO: 779747 - protein, 116 aa, Homo sapiens
ECWWLSSFTGRDSDDSETVATLFPVVLPLSVGWVTAMSVAFCKSTSKFAVTFMVGQIHFTMILPITLVISTHIYLPKVETRTRLETGAGRLLLTGIKWAGGLLLSDGPWTFPVDCV

SEQ ID NO: 779748 - protein, 31 aa, Homo sapiens
MPHSWAHHRPPSSHPVTNTSHHHRMGWHPTS

SEQ ID NO: 779749 - protein, 122 aa, Homo sapiens [sequence omitted]

SEQ ID NO: 779750 - protein, 559 aa, Homo sapiens
QCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIGKPASSMTSPLG

SEQ ID NO: 779751 - protein, 53 aa, Homo sapiens
MFSQEGLHFPFQKRETQNCIYLENARMDVYARMDVYARMDVYARMDVYARMDV

SEQ ID NO: 779752 - protein, 84 aa, Homo sapiens
DSIPRGSKERHLWAVLASGRQFGTSWVFVIILAEPLSCLPGNPSWGGEVKDPGPRLPGHASRMADLGSPRHRSELIWNEAGEFD

SEQ ID NO: 779753 - protein, 130 aa, Homo sapiens
SIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRV

SEQ ID NO: 779754 - protein, 34 aa, Homo sapiens
KCRVLELRIFSESEASCLTGLLTLTHAFLQSLSS

SEQ ID NO: 779755 - protein, 79 aa, Homo sapiens
FLSSLPILFLDNLMYTLGLLGHQVVTHHYHHHTAAGTSSLTRPFSFNNDKHGVQSGPLNPVLQMGTLRHKEVKIMQVTK

SEQ ID NO: 779756 - protein, 40 aa, Homo sapiens
MAFKSTVESSTYSVFGKLLQVYPQNNPAPSSLSTATAWHL

SEQ ID NO: 779757 - protein, 104 aa, Homo sapiens
MIQEAGPWDAESPGALLSDFTAFRAVRNQGLLFPGHPTCGILLQFQLRHFLTERLLLEVMRSQKTCVHWPLCESLRTRERQVCSSVSQPSVSFLSVFLFLGTTL

SEQ ID NO: 779758 - protein, 57 aa, Homo sapiens
MIQCHVKHTPAPGKTLNLDRITGKHQMGPDYQDTLHDDWPGILKNSNAVKDINKTEK

SEQ ID NO: 779759 - protein, 116 aa, Homo sapiens
MSRPSCGALLQPQQAKSGTVNRRPPRESARRGDLSWGNWSLCLSFPNVGEVVPMATGRPPRGPAHQVGRNASPRLLRCTEPHILPSGRLSSPLSYKGWAGPLQDSAEGETQSGSGQ

SEQ ID NO: 779760 - protein, 83 aa, Homo sapiens
GSSCSDSSSTLLLLPHTATVAQDCSVEQPVCCTLLLWATLGYSVYGTALPCLRSHHFAIHYCSNKLAFFHCQLTLEFFLEQSQ

SEQ ID NO: 779761 - protein, 71 aa, Homo sapiens
ACTNRKLRPPLPEEAAMAPAVDSLSPLVWNECPLLAVPGTAAPVTLASQEGAPPSPTHPQLPPPARSAVPG

SEQ ID NO: 779762 - protein, 117 aa, Homo sapiens
LGSWAGRPLASHVLESGLVRSAARLAGCRGLRAALLRRGCVGVGPTCGNCPIRLPGLARLPAVASPPPAADRRGPVSAAAGCPSGPVAFPRRAAPRGLPTRSGLSERPGFVPSGGCG

SEQ ID NO: 779763 - protein, 39 aa, Homo sapiens
ANGITAGWPYNLLSKQGRSLSEEGIINSEAWTTNINVDH

SEQ ID NO: 779764 - protein, 101 aa, Homo sapiens
REGGEWNDLSRLTWRNWWPLSPRSPPCQVPLPHMTQGGCRAASRTLVRQEEGPATTWPCEETQSKPVTSASTQHRVLLKPLLSSQQGSQGKARGRLKRGAE

SEQ ID NO: 779765 - protein, 72 aa, Homo sapiens
MTGSNYMFKLKRNYQTVFQSNRNLHSHQQGIKVPVACEHLVISNFFLPNFSHFNRYVILFIVVLHFPNNSRC

SEQ ID NO: 779766 - protein, 176 aa, Homo sapiens
KLQAMRDIAILKEKQEKEIQTLQEETKKVQAETASKTREVQAQLLQEKRLLEKQLSEPDRRLLGKRKRRELNMKAQALKLAAKRFIFEYSCGINRENQQFKKELLQLIEQAQKLTATQSHLENRKQQLQQEQWYLESLIQARQRLQGSHNQCLNRQDVPKTTPSLPQGTKSRINPK

SEQ ID NO: 779767 - protein, 107 aa, Homo sapiens
MISSALDDCLQDRRPGENLEAIVICRPVNPKICLCDIIGHIAYTIFKRLLSGKYLIQLYNVCDYDVSACCLHRFCIVICSMNYETKVHFLVHEVSFVINVCHMFIPI

SEQ ID NO: 779768 - protein, 76 aa, Homo sapiens
LGLARLTVDRGGLEDTGSAGKYLGHSKNPGLGSPGLKSGLTWSKPAPIPRDPHTLGRSLRNAPVPYSELRLPQDEP

SEQ ID NO: 779769 - protein, 82 aa, Homo sapiens
QHSCHRVSQPMLWPQSQPGSPQGLGPTHLIPFSSPVVRSRGPGPAHAEVQRELVDEQKEHSGLKAGECGFIQQQLLLTAFSH

SEQ ID NO: 779770 - protein, 64 aa, Homo sapiens
MPYLLEAGMMGSLLQGHRKGEVHGSWMARPWLGLESLGERIAAGALEVLAGEGGPRHRRGRQAI

SEQ ID NO: 779771 - protein, 76 aa, Homo sapiens
ERLSYFCNPKLNDAWSLAVHATGLDFHSPDSLFPPPGRSGSWKLREAQGPDDPPGPGQDTASCWKGMPREGLTVDF

SEQ ID NO: 779772 - protein, 108 aa, Homo sapiens
MSQCWPLVSMSVERLLCFPSCRMGTTTSSHRVLRIQGQDTAKVPQSPFLTPAWRHPLSKGRSRDLPTNLSGCEVWPPAWCLCSGPRTEGSLGTWGGQVNLDPDSASGD

SEQ ID NO: 779773 - protein, 116 aa, Homo sapiens
RQSRGLGATTAMAMSPFTGTLKYKGTLHVPKTLTSEALAASPEYGAGGWYGPGAPREPDRSQKQAEGAIIVVVIDASQLYLVSWLAAVHQICEENGVLGAGQPASRHFAWTLLDSD

SEQ ID NO: 779774 - protein, 106 aa, Homo sapiens
SPTTALPECGGILVARQSFPSSPIAPCVSLTKSQAQLNFVYLSHRKSFLPSFPQIFFSTHPRVSAVLDAGAGAVDKTKILLSELTFGFELMVMGRERNNQGNFRHW

SEQ ID NO: 779775 - protein, 95 aa, Homo sapiens
EGRGRQDRELQEVGVGPGMLGQRCYPGRTAWPGYAGSRVHAAPLGCMTSPPAPLRFLGGLRTWAKATDGQGGQAPPTAAGPGPLPTVLFFGVIAY

SEQ ID NO: 779776 - protein, 60 aa, Homo sapiens
GDSRGFRLACQWEAKSVPASHPDLLPLQKRPCSSCLHLAGSTATEFAAVPAQKREFPAQG

SEQ ID NO: 779777 - protein, 104 aa, Homo sapiens
ASLPLQIPPAPQPTAGSRRGQTAAAREGPSPSREGRARVRSPHPTHSAVSNWGHLRVPATLLALWSPGLQVSPKGPSVQGMQPPECPHPTVELRSLSAPWVLAG

SEQ ID NO: 779778 - protein, 89 aa, Homo sapiens
KWQMEGNGFWKAPGGLGWVLETIFQLLFRRRVGQISSVATWALEGRDTGRCGHRRESTMCGGSPQLEPKGPRRDPGSDISQPCGLGQGP

SEQ ID NO: 779779 - protein, 109 aa, Homo sapiens [sequence omitted]

SEQ ID NO: 779780 - protein, 79 aa, Homo sapiens
QPRTQGEHDPAPGARSALTARPEQRVPHVPAHGNPAPSATSLTAGPGRWVPHVPAHVERLHHLVEEGFITEASAKGTAA

SEQ ID NO: 779781 - protein, 73 aa, Homo sapiens
RVFSLSGGPLTKAEVNIAMGRFSGEVGPRALRGWPPTPALHTILEGLPCAHFLLASTYFLLLLPPIPTEFTLS

SEQ ID NO: 779782 - protein, 76 aa, Homo sapiens
AGPKWGGGAGGALLEAFGCSQRMVVVCEPAAPRQTQIETVMRARNLEPGDRRQWGTTLLPLLCHPNTLASFSFLLA

SEQ ID NO: 779783 - protein, 105 aa, Homo sapiens
MRTLPLLPDHLPKSLHFLIPSSWGLQFQHKFWGDINTETIAFCPWFPQIHILFTCQTNSFYPNNPQSLNSFQHQLKSPESNISFKYHLNQLRLKLKAQFYLTQNS

SEQ ID NO: 779784 - protein, 59 aa, Homo sapiens
MHTDRHAHPEIWWCTSALAPGRCWTCWLNGGNWCISTYCVPSPSAQGPKKLLHEVSQPR

SEQ ID NO: 779785 - protein, 120 aa, Homo sapiens
LPQPPSSWDYRHVPPRPANFVFLVEMGFHHVGHAGLELLTSGDLPTSASQSTGITGVSHCARPKISTLYAYLAQQDLALTYLTQLICQIPTLFQSTTFFFTFPQSKHIPASGPLHRLLPL

SEQ ID NO: 779786 - protein, 35 aa, Homo sapiens
RVTDMSTEEPKCSELLGLENLNYIPVSIGQTSNTL

SEQ ID NO: 779787 - protein, 96 aa, Homo sapiens
PWVSVEGGTALCDKREARYVIREKLMGAKGWGWVSQGLGQHGDLSAPRLIWQERLETSGRQLQANCRLSQPLSAERIITCGWRGESLALSSPAWRD

SEQ ID NO: 779788 - protein, 111 aa, Homo sapiens
FTCVPPAPRRVSLPVFPPLRVGSLCLVPPALGRICPRDSRGLHLIMSEPSSELCPLRPRLLQGSRQVPGSACPSSRKQTRAASKPQQPAGQRWQTTPQCLGGRRSVSYILC

SEQ ID NO: 779789 - protein, 134 aa, Homo sapiens
MLKKMGEAVARVARKVNETVESGSDTLELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 779790 - protein, 184 aa, Homo sapiens
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 779791 - protein, 100 aa, Homo sapiens
QAGTALAMYGHLQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 779792 - protein, 128 aa, Homo sapiens
MLKKMGEAVARVARKVNETVESGSDTLDLAECKLVSFPIGIYKVLRNVSGQIHLITLANNELKSLTSKFMTTFSQLRDVPVEKLAAMPALRSINLRFNPLNAEVRVIAPPLIKFDMLMSPEGARAPLP

SEQ ID NO: 779793 - protein, 184 aa, Homo sapiens; identical to SEQ ID NO: 779790

SEQ ID NO: 779794 - protein, 101 aa, Homo sapiens
MMHLKYRRYMYVAKMATSCEQRHDSNLTGRGAGRKVTCTLTSSGEDTQAPYQVASLENPCPHDWRPAFPIHCLVSTPRPPCSPAADFGTPTLQAVLESPRG

SEQ ID NO: 779795 - protein, 792 aa, Homo sapiens
QVGYPEWISSTQRPRWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVAEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 779796 - protein, 821 aa, Homo sapiens
QVGYPEWISSTQRPRWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVAEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 779797 - protein, 1619 aa, Homo sapiens
HHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSDNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVAEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 779798 - protein, 156 aa, Homo sapiens
QVGYPEWISSTQRPRWLFRLDISFESQHILLRGDKTSSLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGGSQAAASARST

SEQ ID NO: 779799 - protein, 1173 aa, Homo sapiens
HHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSDNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRDSTRHTEKLSFPTLEACALGFKKKRKKERKKVSED

SEQ ID NO: 779800 - protein, 1619 aa, Homo sapiens; identical to SEQ ID NO: 779797

SEQ ID NO: 779801 - protein, 134 aa, Homo sapiens
HSESIPTSYPTTGALLSPFTALSPPLDLLALLLLTLGPLPCRLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 779802 - protein, 62 aa, Homo sapiens
MGRSSTKHPREAVIRGRVTHPYSQTDLGTGKQHSIPNQLMRDCSCLAPGPSRPWNSSDPICG

SEQ ID NO: 779803 - protein, 107 aa, Homo sapiens
TVSTLYLRNSNLEKSAFHGQRPNSHVPTGPFRSAGGTQRAGCVRGLCTCCFPGLRCCSPKSWRGYSTAGHPSQQATCEAAPCSHSPTQCSTGQTASHSSEYFYFCFF

SEQ ID NO: 779804 - protein, 38 aa, Homo sapiens
LSQSLNFLVLKIPPLLSGAGHSCHVVRMCALAVVTSSA

SEQ ID NO: 779805 - protein, 77 aa, Homo sapiens
QYGCGRYCYKWHLPDSRAAGVTLWGPGANLPLGSAWRESILQVGSEKTCIHKEGFCVENPIGLAGSSKRVYWQSSKS

SEQ ID NO: 779806 - protein, 117 aa, Homo sapiens
GVSKEPEGAWLQDPGIHVGQSPAPPQLEPKGPAGQDWRLPPALCPSEASSALILEAPRVAVRARIPARLSPGSSWQQAPSMPSPPRGPPGNACPASCWRLPRAPACPLKTGQTCMSP

SEQ ID NO: 779807 - protein, 115 aa, Homo sapiens
RLSQGKGPDIFHRLGPLSVFSAKNRWRLVGPVHLTRGEGGFGLTLRGDSPVLIAAVIPGSQAAAAGLKEGDYIVSVNGMPSPPRGPPGNACPASCWRLPRAPACPLKTGQTCMSP

SEQ ID NO: 779808 - protein, 111 aa, Homo sapiens
LASGNRWGLRPSRPNPGSCQLPLGQVQAAGLNASQGGSRCASLILGSQGAHSDLTKGSAPTAPMSQSHPACHGAMPSLWPSPRPWTPAPEMALPLLPLGMAVAPWLSSSPL

SEQ ID NO: 779809 - protein, 118 aa, Homo sapiens [sequence omitted]

SEQ ID NO: 779810 - protein, 208 aa, Homo sapiens
MMRLLNNCENCCLDAWDKIQDDGKVCPSFTAVRQGQHEPYPDFITRLQDAAEKAIPDSHGQRLVVELMAYEQANPDGQAAVCPAKGKIPPGGDILTSYIKACEGVGGTLHTATIMAQAMASIRMPGHSLANASYAARRDMQKEIALGVQVAVLYITTNNKKKLFSNKTPHLLLYAHEAKRVFTGHLNAIPDLILMAILYGLFKNQETG

SEQ ID NO: 779811 - protein, 76 aa, Homo sapiens
VLRIPDGVLHRQVVLHRQVVLQRGRLYFCLSSLERGEDIVFLRMWEGALKCLLRFLLRSEVTKGLNFILATPASVI

SEQ ID NO: 779812 - protein, 107 aa, Homo sapiens
RPCVRHTSENHLAPPSLSSFICRLRVSASSTQTALTQLSTLLTSVMICSGKAFVITSFHSSLPGHTDMTRRRKVEVFLEDRKMIFPISLPTDSKSSIPLVAESWTGI

SEQ ID NO: 779813 - protein, 142 aa, Homo sapiens [sequence omitted]

SEQ ID NO: 779814 - protein, 35 aa, Homo sapiens
VGSGNWEVVSVLTSVEVAILLFGEARPGVFGAMGQ

SEQ ID NO: 779815 - protein, 111 aa, Homo sapiens
SLAGIGFGTLGNKSAFSPLQTTSASYGGDSSLYGVNPRVGISPLRLAYSSAGRGLSGFMSPYLTPGLVPTLPFRPALDYAFSGMIRDSSYLSSKDSITCGRLYFRPNQDNP

SEQ ID NO: 779816 - protein, 110 aa, Homo sapiens
ALSTLILNRLKVGLQVVAVKAPGFGDNRKNQLKDMAIATGGAVFGEEGLTLNLEDVQPHDLGKVGEVIVTKDDAMLLKGKGDKAQLEKRIQEIIGQLDVTTSEYEKEKLN

SEQ ID NO: 779817 - protein, 70 aa, Homo sapiens
RRPLFTKHHSYYCLKRPGKLSDQTFAPMVQSRLEKAQSLQGGEAEVAGADPTAMPSPLVPDLPPSMNAAH

SEQ ID NO: 779818 - protein, 89 aa, Homo sapiens
EEGPRQKADQKAEVDGGRDIFRSGHSLPHILWMLSWETGTREPSCHVGTARPRVYAHGSIPSPKGTDMEMRALMTLMPVLGPVWKGERA

SEQ ID NO: 779819 - protein, 93 aa, Homo sapiens
GGLRGVCWSSVQLFSLFSSELLQFPSGHILPPGPGHLTQMQPSEHTYPRALGFREVPLTSSGPVPCTLSSTMQGEQEHTFAPSLCWPRGPRGA

SEQ ID NO: 779820 - protein, 75 aa, Homo sapiens
PSMPVGLSWKPHAPCHALVTSGRTGAVILSVWTWTWAPGILLPCPSDKWPDWSCNLISPDLDLGPRRPPPGRPWS

SEQ ID NO: 779821 - protein, 206 aa, Homo sapiens
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESAN

SEQ ID NO: 779822 - protein, 113 aa, Homo sapiens
VGKQWGWTQGRWPKKSAKFLLHMLKNAESNGELKGLDVDSLVIEHIQVNKAPKICHWTYRAYGRINPYVSSLCHTEMILTEKEQIVPKPEEEVAQKKKISQKKLKKQKLMARE

SEQ ID NO: 779823 - protein, 73 aa, Homo sapiens
VLSATPPATNAMRAGPGPGGHQHLALQTPEKCLLNEGLNGQRLSHPWQVGHTPKPARRDRPCPRGQGAKVSAL

SEQ ID NO: 779824 - protein, 502 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 779825 - protein, 502 aa, Homo sapiens; identical to SEQ ID NO: 779824

SEQ ID NO: 779826 - protein, 564 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKHGTCSETTGVCSDVLGQNESDFQERSEEFDSEKTRSKSQLYCLVRISLGKIIYMLNNLPFYLGDEKRIMFPSIKKVLVRIKRNGEL

SEQ ID NO: 779827 - protein, 266 aa, Homo sapiens
MKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 779828 - protein, 502 aa, Homo sapiens; identical to SEQ ID NO: 779824

SEQ ID NO: 779829 - protein, 355 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQGYHDPDQFDGAAQGPHRVGHP

SEQ ID NO: 779830 - protein, 489 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 779831 - protein, 434 aa, Homo sapiens
MMFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 779832 - protein, 103 aa, Homo sapiens
CCNSLSKNALLSAGTVRTSFTQEFLWPVFRKKGVDQNAFLASAVSQVPLAQNNLYVKKAYYGILWGATLHCQIIFHHMTIPHFMYPFVILWTFRLFPHIGYCE

SEQ ID NO: 779833 - protein, 134 aa, Homo sapiens
NLSLFIFYYYFTSEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKM

SEQ ID NO: 779834 - protein, 50 aa, Homo sapiens
MEYLSHNACVGSTGMITGLAVAKEQHKKDFVSVFNELICKHIWNQEQRTR

SEQ ID NO: 779835 - protein, 81 aa, Homo sapiens
DEQTEAQRWCYVLEATLQGWVHLTHELVPFNQHVIVGGGSMKTMAASHLIERKDGQREGRPPVLKLQSSALQYPERGTPRL

SEQ ID NO: 779836 - protein, 41 aa, Homo sapiens
PLKGSVGLQYNLNLPHMAITRKLGLELEGALEKYVFKIHWN

SEQ ID NO: 779837 - protein, 115 aa, Homo sapiens
REGATAESQRQRSGREGGLRGGSWAVHVEREWEEPMLRPHTLTFFQGTTESPKMKEPTDMVSLPKGRCELRKVNCKSGGANRKCSAQAPLAPLSPYFFQVKTLCPHHRKGSSPLS

SEQ ID NO: 779838 - protein, 73 aa, Homo sapiens
GSRTLLLVRYHGNTGLYCCKASQTAPITSVKPKFHPHLLVILLFTVLNYSHMPCSCLHCRFTLFLQDITGDIS

SEQ ID NO: 779839 - protein, 118 aa, Homo sapiens
ADSLLDSARLHPGEINSHVLTQKPVGGLFTRTCMKFGAVTRIRGPPLGDQSPILLLFAPEKDPPTTSGPETDQPKKHLTNFKSGRNVRPLSPSQAIASPVTCTYTPRWPEVTEESQKK

SEQ ID NO: 779840 - protein, 243 aa, Homo sapiens
MESKAWESNNEDLLSSSGVTSNGGSSSSFFVSSIRGTIIENTSSAGTLTQVPFFPKYEVELDSPRKIIPSPGKEHFERVLEEYSHQVKDLQRRLNESNELHEKQKFYLRQSVIDLQTKLQEMQMERDAMADIRRRESQSQEDLRNQLQNTVHELEAAKCLKEDMLKDSNTQIEQLRKMMLSHEGVLQEIRSILVDFEEASGKKICEHDSMSTLHFRSLGSAISKILRELDTEISYLKGRIFPV

SEQ ID NO: 779841 - protein, 557 aa, Homo sapiens
MFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEMVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 779842 - protein, 471 aa, Homo sapiens
SGESLLSSDLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEMVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 779843 - protein, 563 aa, Homo sapiens
MAHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEMVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 779844 - protein, 436 aa, Homo sapiens
MEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 779845 - protein, 138 aa, Homo sapiens
ISLIVQNQELKYISYLSDLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSEC

SEQ ID NO: 779846 - protein, 148 aa, Homo sapiens
RGRSGGGHTHACLAVGVVLCEDQQWPYPALRDGTLRWSQASREPGDWGTGGPHTLFSSAPPSHHYRRHPPESVASVLCVGLCSWFSFAFSFKSELSPWELVRRAPTGGGAGGTFPILWGWLRPLFQEIFCVCRSPNTPPLAPRALSAH

SEQ ID NO: 779847 - protein, 118 aa, Homo sapiens
SVFLWGQIKEKGGEQIVRSGLCSCACWVGFPEMCILSYFFPLWASVSGREEGRLPGPVSCSFPSLPPVHILSSCCNPSSSGLLCRFRSLNPSNTPRRAPAGASVGRQQDYHTERAPGE

SEQ ID NO: 779848 - protein, 119 aa, Homo sapiens
VLGTRGPWPWHGSSTQGSWQPGSQEAEEMRGEVSPSKGKEVGCAVTVLEHSLDQQHPYHLQTGWKSSLRTNIITSPAVIHKYFKKWSIISAKQSHTVRGTTGGLCVLVSVFLPLSRHVD

SEQ ID NO: 779849 - protein, 39 aa, Homo sapiens
PETQAPDSTRERRHSPGQPPPDGDNHRPVTWGCRRPQPY

SEQ ID NO: 779850 - protein, 153 aa, Homo sapiens
GNLVGDSTNDPSMEAAGFTAQVITLNHLMANMKRRDAPVLGIATRYPDCMLSLLQLKGKKIDPPVSGKKAWRVWAIEVSVNVLVMRARLLIWFAGKARCVLGELLVEISPVVVVSDSPAGDVVISEHMQLGFGRLEVVNQQRQVDKEGLLELG

SEQ ID NO: 779851 - protein, 146 aa, Homo sapiens
QAQLQGLLSFASTIPSSPCSRPSPTIWQSGQSNHSHIRALPGSFIECPLRRLEERPMTFALETPESRFITTMLRLPVWLQGHFFHSFIYNRCSICCVPDAILGSRETKQSPCFPRHPHSRKDCYQPGVVAHACNPSTLGGRGGRIT

SEQ ID NO: 779852 - protein, 451 aa, Homo sapiens
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 779853 - protein, 451 aa, Homo sapiens; identical to SEQ ID NO: 779852

SEQ ID NO: 779854 - protein, 109 aa, Homo sapiens
MLGIWEWQRKLEFSLPCPLSGSPGLSEHYQCCQRRHSTLQLNCTASLPHGIFSHTPTPNHRPSQHRNHLSVLVSPVHIHTCTHIQVVHTCKNQHASKSSLMGVGGSCCP

SEQ ID NO: 779855 - protein, 69 aa, Homo sapiens
CGDVTSRFRYHRMPVLPLGQPSLEIIHISFLERSAGEFLLHAILILSSRALNNSCSLRDLGPGPARKCL

SEQ ID NO: 779856 - protein, 124 aa, Homo sapiens
MNGFRFEIYKDMSCVIWDELFMDSFLKLPFAEYLFQLSSGVTSFRKPTLILLAPPWPLAAPSLCSHYTLFISLLTLFSHGIKNSIIFLNIPPLNCKLIEKIALISCSLGTVLIFSLRNHLSPSL

SEQ ID NO: 779857 - protein, 51 aa, Homo sapiens
EAGKIVSSDFKKKTLGRAGSHSTPWHRAGRVTPHRGIEQGESPHTVASSRE

SEQ ID NO: 779858 - protein, 89 aa, Homo sapiens
SELKLGVRVERGWIQKEASLGTGMERRERLSHGKGQLDHSGTNQTWPRREAQCLFQRTHVPLDTSSQAERFTDIHRDIRIIPQHAQTNT

SEQ ID NO: 779859 - protein, 99 aa, Homo sapiens
HLCLHFLHSPAKQKLPWNQGSPKTPNSKEAAASCENSLSLFISLPTGTLMLTARRMRPSQEPPEISGPVSSCLLQPHSWPHCQEDSQRSHRGRCGSVHL

SEQ ID NO: 779860 - protein, 105 aa, Homo sapiens
RGKPRSISLHLPLPRQEAEQNHTCNPATRPPGCVLPIFHPLCLARCLAQRRHSRGTGLNPVASEQLPGEAGVTPFKGHWKDAWSPFLPRHKPFLYCPTLMPEVKQ

SEQ ID NO: 779861 - protein, 116 aa, Homo sapiens
NGARPERRPPPRPSRIHNPSNSYPLQQYTLRTMNHNQCYQSILIINNHNGYSNKTRNSPLSLLSPRGYPRHPSDIRPASSHMTKTSPHLNHIPNLSLTRRKPSPHSLNLIHHSRAS

SEQ ID NO: 779862 - protein, 104 aa, Homo sapiens
GPRGSELGNNEQFPLEMPIYTFQLPDLSVYSEDFRSFIERDLIEQATMVALEQAGRLNWWSTVCTSCKRLLPLATTGDGNCLLHAASLGKLHSTDRGWPGSRPA

SEQ ID NO: 779863 - protein, 156 aa, Homo sapiens
MRGEVFKCNSEVQRRLREGVQRERGRWWGCYQGLPRTQGLHNPPGTSPEREQGLDACQQRGAGLTALSLGFLSGGNAGSFERVLSVQAVCTPLSWSPLSTLAHLIRGCGRAGYFSHLPAAVELVPTYPVGSKMVLKPLPRKPSQVELEEGVSFNIP

SEQ ID NO: 779864 - protein, 96 aa, Homo sapiens
ITITITITISISITITISITITITISITITITISISITISRTFSSSLTKPLCPLNMNSPFLPVPQSLETSIPLSAFKNLPILGPHSIFKLPEVANI

SEQ ID NO: 779865 - protein, 44 aa, Homo sapiens
ILLQRTCSNMLRKLRQRKVDGEFWKSEKGSELIEQNGNRFQQFS

SEQ ID NO: 779866 - protein, 88 aa, Homo sapiens
LLLPQQSPNGSTSRTSGGSGLNLGFKLESPRDPEKPLRVSSPEILIQLAWHMDLHCGPTLTSAKACTRTDESHARTSRHKSARPPPPA

SEQ ID NO: 779867 - protein, 83 aa, Homo sapiens
VRMCGPSDVRASTDVRASTDACSKEQIPRSKVSDYCLKQEAANTPILLRNTPLDEPEMMWLPQSIDSSPLQVVEPKEFLVFPF

SEQ ID NO: 779868 - protein, 101 aa, Homo sapiens
RKDSCQDVFLLSLHQQVSVSPRGQCSRQVMWRMDRGFGGRDPCTRRQRHLQCRGERTRGTEAVTETQDVARVPEGRGDAFQLARVPEGKGDSFEFTEKKKS

SEQ ID NO: 779869 - protein, 296 aa, Homo sapiens
MSYLKQPPYAVNGLSLTTSGMDLLHPSVGYPGPWASCPAATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 779870 - protein, 288 aa, Homo sapiens
MSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 779871 - protein, 296 aa, Homo sapiens; identical to SEQ ID NO: 779869

SEQ ID NO: 779872 - protein, 296 aa, Homo sapiens; identical to SEQ ID NO: 779869

SEQ ID NO: 779873 - protein, 288 aa, Homo sapiens; identical to SEQ ID NO: 779870

SEQ ID NO: 779874 - protein, 97 aa, Homo sapiens
MLFTRFCTQSHPKTIISTRFLESAMSTTSRAWRIHATSGITTWSGPKVTHSRSHPPATPPGRTPKGLSVPAPETTKAGGQSFKICYKETYIHSDIHK

SEQ ID NO: 779875 - protein, 31 aa, Homo sapiens
MQQPLKTSLGRQNSTEIVTKGRYQSLTVPTC

SEQ ID NO: 779876 - protein, 67 aa, Homo sapiens
PTFLPAEHEGSAGTPPACMCPDMYVQADQRFPLICHQEHQLVLEDQVLAPRPQWEQGEDEAGHPPKW

SEQ ID NO: 779877 - protein, 58 aa, Homo sapiens
MAKRDSAGGIKMIVRVGLIYSHVLFKSRVSSGQQQGGSQKDMKLRKDSTLLLALQMEG

SEQ ID NO: 779878 - protein, 35 aa, Homo sapiens
RSMLSALLAIMIPTSHMEGVQSGGRTCLTKPDNTL

SEQ ID NO: 779879 - protein, 56 aa, Homo sapiens
EADWVMRVTSPGFPGNEAATPHFLLLLQRKLGVLGCFLPLTSGETPKPLSDRAVVG

SEQ ID NO: 779880 - protein, 120 aa, Homo sapiens
PGKFFCIFSRNRVSPYLLGWSRTPDLSDPPPLGLPKCWDYRSELLRLGHICFFTFSLCRCIHIKLVFLIHLEKSCGHQDSLPLNLEVCTNQYIFLHDTPPLLDPRTSALMQLYPLVYSSS

SEQ ID NO: 779881 - protein, 68 aa, Homo sapiens
SCGEQCTPARGRGVLCPCSEGSAAVPIDLHLRLCIRGDCPGGPRQSHITILMLGVGLALIIRWLMVQG

SEQ ID NO: 779882 - protein, 105 aa, Homo sapiens
PQGTGLDSGWEAAHPAAWPGSALGRVWAGGVGGSVSLLGRWLGEAALQQGTRGDLSLAFPSLTRKCGCDHNVVHVARSIWNSRNHRLSNVHTPSRGCNFTFTSTH

SEQ ID NO: 779883 - protein, 260 aa, Homo sapiens
SALEWSPFQAWSKTELRDFSLNLRSHTRSTMTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKD

SEQ ID NO: 779884 - protein, 241 aa, Homo sapiens
LPYCIIFRAIKILYPGILNSGEACGSASLDELIEIGRDWKRPWPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKD

SEQ ID NO: 779885 - protein, 235 aa, Homo sapiens
SALEWSPFQAWSKTELRDFSLNLRSHTRSTMTSPQLEWTLQTLLEQLNEDELKSFKSLLWAFPLEDVLQKTPWSEVEEADGKKLAEILVNTSSENWIRNATVNILEEMNLTELCKMAKAEMMGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKD

SEQ ID NO: 779886 - protein, 71 aa, Homo sapiens
DFSRAAGSPNIYGKFPNIPITVVATLDMACTLSVLCPTLGAGWQRGSLVQCCQVSVSGSPALHPLPTVLSQ

SEQ ID NO: 779887 - protein, 30 aa, Homo sapiens
MPRGFTHDGGWTWHLLNRGWMWASLWSLSV

SEQ ID NO: 779888 - protein, 104 aa, Homo sapiens
YLLDLVGFYVVQVYFLVDIVRGDSKHYLIYGANFSIKQFLPPILSIVLSRLIMCSEGIRLFPYTHTPLNTIVTEVCGGFSTFTTNSPGDTSWVFYNSIIILCIC

SEQ ID NO: 779889 - protein, 124 aa, Homo sapiens
ILPEPEHRSLPRSTSSKLHGLDQAPLLPHFLLSRMEIIKPPPCKPPSQKAVVRIKQDNNGETSLKTVRCQSNLRASERAAVNRYCTRQLLGAHWEPLTTSMVHVPVSRADRVAATQASFLRYFL

SEQ ID NO: 779890 - protein, 106 aa, Homo sapiens
MLQTCKQCQCLFLFITSSLHLCLSHSERPSINFMMDFRCSTPSICSFLYSQPTFCLQHGFCLLTQPLLPHGFCLLTSLCILFLFHAITLCGDCMYLIQIPKEKNCD

SEQ ID NO: 779891 - protein, 104 aa, Homo sapiens
DLEDPLGWGRGLAWERAGLGKRAGLGKRAGWGRGEIGFAESSCSLSLPVSDACFLSSGRTSDSMFFSLGIWDLNQQPSGGPRAFGFRLRAALLASLVLRFSDLD

SEQ ID NO: 779892 - protein, 82 aa, Homo sapiens
ATHPCTVFPQQPSLGTFPKGSRKQLTQQTFGDFRKQKGRQVTSISSLKSPPGSRLLRGLAQPASRQHGLSIFTVLLITSAGG

SEQ ID NO: 779893 - protein, 110 aa, Homo sapiens
HCSSLSGKKFRHSELFSHFLSIPAVSARPASASKLPVLCTAMLDLWILCSSTCHGLPNLKMLPVTLCQALSPFTNLVCPFLILIPGSPSKSSQTQHISAMDFTSKHSLHF

SEQ ID NO: 779894 - protein, 103 aa, Homo sapiens
MVQSPNQRRSTLSPAWPGPGAPGASRKQNQCLSHLVAPGLRRSPQPVGHPPGNWVLRLETLGCRSSGWAGTFRRPERGPLTSIVRRGRCPGRIPTGKGCPGAQ

SEQ ID NO: 779895 - protein, 109 aa, Homo sapiens
SSGCCWERLPAPPHAEIRGADTGGFVLPAPPHPEIRGADTGGFVLPAPPHAEIRGADTGGFVLPAPPHVEIRGADTGGFVLPAPPHAEIRGADTGGFVLPAPPHPEIRG

SEQ ID NO: 779896 - protein, 48 aa, Homo sapiens
AGITGVSHRTRPAACISEIQVKWPSWDTSLRADSEPRFPSFNTPSFPT

SEQ ID NO: 779897 - protein, 132 aa, Homo sapiens
GREPLDQLRVSGPVGADNWPQSTPTWWLSPRTLVGLWVIFLIFKFLFEIESCYVAQAGLKSLGSSDPPASAPRVAGTAGVSHRTWLGMLMVVSPHRGTVTGPRSHQACPCSHSPQMQRGGMVWGLVSGNSST

SEQ ID NO: 779898 - protein, 117 aa, Homo sapiens
VYRLHSQPSQSYPGTSTRWFIHLTIYQRYLQESYIIVKPDKGVEKPHTEGSQIGETTTDPFSEGVSVFVCKFLFPRGCSPKTKRRVCHRDLQEKKNLARLDLFLFSVKSNSKLIYIL

SEQ ID NO: 779899 - protein, 425 aa, Homo sapiens
TLPLHPNQGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFCYCDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 779900 - protein, 145 aa, Homo sapiens
TLPLHPNQGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGSYTPTHSVTDLLGGFFALQSVVMCLRREQSVFVIQTMRS

SEQ ID NO: 779901 - protein, 70 aa, Homo sapiens
NNELKSLTSKFMTTFSQLRDVPVEKLAAMPALRSINLRFNPLNAEVRVIAPPLIKFDMLMSPEGARAPLP

SEQ ID NO: 779902 - protein, 70 aa, Homo sapiens; identical to SEQ ID NO: 779901

SEQ ID NO: 779903 - protein, 70 aa, Homo sapiens; identical to SEQ ID NO: 779901

SEQ ID NO: 779904 - protein, 81 aa, Homo sapiens
SLGKVGKGVGEGSGVNAGTTLESGVDKAKSGLVKMRSGFVREAGSGVGGEVSGASEVASDVKAEWGVSSRLESEVSAGPGG

SEQ ID NO: 779905 - protein, 79 aa, Homo sapiens
RLYRAGEDAVWVLDSGSVRGATANSSAAWLVQFYSSWCGHCIGYAPTWRALAGDVRDWASAIRVAALDCMEEKNQASFA

SEQ ID NO: 779906 - protein, 210 aa, Homo sapiens
LFLTGEDLGVISLCQNGASLANLKVRFKPPSPRVFTVTIVALWMFPSCFQDRDIDGGCRLSTASVSSFPHKHVYILRMPFNLCPILQALCFGIWSTSPHPPVGSWLPPPLGPACTLQSARSPSPPVPPSPLLQAAKCFLLAGRGQTEPEAQSASAAPPSKCSRDYPVFVAASLGQVPEGSPCSSGCSTPDVGISTGEEPRNSVAVLRFRK

SEQ ID NO: 779907 - protein, 73 aa, Homo sapiens
LHGPMANGCHTGRQTLNISIITDGPTGPTPSSTGRTDHCPPAAHSPSLLSIFRGSNRSSLKTFPSCWKPGMMT

SEQ ID NO: 779908 - protein, 592 aa, Homo sapiens
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 779909 - protein, 600 aa, Homo sapiens
AAFPVAGSGPGGLPFPKHWPGKSPRRGLLPRKTRRAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 779910 - protein, 277 aa, Homo sapiens
LIKIFLFRQNLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 779911 - protein, 257 aa, Homo sapiens
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDVSVNCSYI

SEQ ID NO: 779912 - protein, 592 aa, Homo sapiens; identical to SEQ ID NO: 779908

SEQ ID NO: 779913 - protein, 443 aa, Homo sapiens
MTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 779914 - protein, 152 aa, Homo sapiens [sequence omitted]

SEQ ID NO: 779915 - protein, 108 aa, Homo sapiens
MTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDVSVNCSYI

SEQ ID NO: 779916 - protein, 139 aa, Homo sapiens
DDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSQKCAGCTQAHFSRRLRDLLTRRLTGSNYPGLSISL

SEQ ID NO: 779917 - protein, 109 aa, Homo sapiens
SPFPALPPTSTPAPRRPGALGAGVSQSGQERGQYTGVGLSTGKCHLHPLTPLLVGKTSGATGCPEVNVLGGSQPHHVSCRHPGLQESQPYLGMTCWPTQGLHLSLVFSR

SEQ ID NO: 779918 - protein, 144 aa, Homo sapiens
RGVRQVWWGGRIICMQEDESELCAWRKAPNWMRAGRARTGMGWGRLACYRFDQVPVRGRKFPYQSKETLHRPEEGYLKSEGGGRGSFPGGVPHTSQSGEASHTNQRGMVPTLTRGGGAPHESEGGGPHTNQSGEVPHSNQRGMV

SEQ ID NO: 779919 - protein, 80 aa, Homo sapiens
MKKTEEEQRKRKQARRRKKERHKDKTEQRKDKREKGNSDEDIEKTRGRREKKMRDRARGGGRERKEKKKREKRDKKDHRG

SEQ ID NO: 779920 - protein, 111 aa, Homo sapiens
YGHRIGSGTGHGWFWKRQHLSGKTGMYVLTLGCGFRLEVGALAGDLPSSAQNSPASYLYYLYYLSITKYLMSSYQEPGLLWKESRMRHRNHFKISCYVIAQKKLTCMNSSQ

SEQ ID NO: 779921 - protein, 68 aa, Homo sapiens
VLSPPPPWMGKEAGGLLQESEDGVGMMGAGKGTEPGVLGSLLLSSLLTLSQRGPGSYWPQPPQYWLGA

SEQ ID NO: 779922 - protein, 165 aa, Homo sapiens
GSSCAGDLGTSQEETQEMGAGPCHCQHDPTAGRACSTPCSRGPGLGQGSPSPPLFSCFLCPTVVGWRELVDCLAIEPPLRAALQELHIHLSGTTPHWAITNSLCDLRQVTSLWAWVPQKSKKALNQRLSLHLCILEFSERMSGKSPPLGSFPVGGDQGRGCRDFP

SEQ ID NO: 779923 - protein, 77 aa, Homo sapiens
GGLGGGQGHPQMSDDKVDRVQREVHAEAWKLKTTRLEEGAAPRTQNVQKGRMESAKPCQEMRALLCEAIGFWNKMTL

SEQ ID NO: 779924 - protein, 65 aa, Homo sapiens
MRTELQNGSGDRSRDWERGSRQRSLEEPAQPQGPGKAGDTTSQHSTPHHSLQLGGPVIAAPTGTG

SEQ ID NO: 779925 - protein, 44 aa, Homo sapiens
GTLLAQEGSVRYERVLVQLPRQSSVIFLRGSELKLTSYQGLRSL

SEQ ID NO: 779926 - protein, 100 aa, Homo sapiens
PLSPLSMSTIHHHPLSPLSMSTVHHYPLSPLFITTLYLHCPSPPSISTVHHHPLSPLSITTLYLHCPCPLSITTLYLHCPSLPSVSTIHVHCPSPPSIST

SEQ ID NO: 779927 - protein, 518 aa, Homo sapiens
MLCASFLGLGLSVAIVGPTFQDLATNVNRNISSLSFIFVGRALGYLSGSVIGGFLVDVMNYFLLLGISMSATTVGLYLVPFCKTAILLTVMMSIFGVSIGILDTGGNVLILAIWGDKGAPHMQALHFSFALGAFLAPLLAKLALGPTASAENHTESDFHPALNQSSDADSEALFGVPNDKNLLWAYAVIGTYMFLVSVIFFCLFLKNSSKQEKARASAETFRRAKYHNALLCLLFLFFFFYVGAEVTYGSYVFSFATTHAGMKESEAAGLNSIFLGDICSLRGWQSFLLPVYRPGTMIVLSNIGSLTSSLFLVLFDKNPICLWIATSVYGASMATTFPSGVSWIEQYTTIHGKSAAFFVIGASLGEMAIPAVIGILQGKYPDLPVVLYTSLGASIATGILFPVLYKLATSPLDRQRKEDRKSEDQKALLSSSGLNEYEEENEEEDAEKWNEMDFEMIETNDTMRHSIIETSRSSLTEPTAEVYNQYPSNALVFESSPFNTGSAHVKHLPETRTKGTNV

SEQ ID NO: 779928 - protein, 518 aa, Homo sapiens; identical to SEQ ID NO: 779927

SEQ ID NO: 779929 - protein, 111 aa, Homo sapiens
MSLCQNLLVAFQSRSQGSSVACKALHELTSHDLSSSCPHVLCPRYPDILAVCQAHQACSCPGVICTGIHFAPDTTWPTLSPSYSVHPMMPTQLPYLKLQPVAPPLSPAFLT

SEQ ID NO: 779930 - protein, 92 aa, Homo sapiens
QHWRSCGVGGAGEATRGGLFPVPFPSGDSWPEVTQHWMRFQGQRPWCPGLWTTPAHSHCKPQTGAVDNASPRQPHAPDQHEKNAGRQHLHLW

SEQ ID NO: 779931 - protein, 147 aa, Homo sapiens
VTQHWMRFQGQRPWCPGLWTTPAHSHCKPQTGAVDNASPRQPHAPDQHEKNAGRQHLHLWSLACPPWLHSIPHIKGTILSEALSGFLVSDRRTKTVAGLRWLWLRKEATPTASRTTLSSSLAPRGRGVNTLGRGGCTLMVLSSDLCD

SEQ ID NO: 779932 - protein, 66 aa, Homo sapiens
IHPGTHYHHLIHNFHNYGTTFNHCSNYRKGQTTFTSSTATLPGATAPGQESSFLGHIHKTSKRLTY

SEQ ID NO: 779933 - protein, 111 aa, Homo sapiens
LHLDAHKYLTFNTCKVQVHALSQLPQFLPRQYKCSIIHLAAQVADVGDNFDLPFPSASTSSPLAGAVDPRSKQSHKLQVSVQVSPSPLPHISHVSNPFHEDCCNSPVYCHH

SEQ ID NO: 779934 - protein, 63 aa, Homo sapiens
QAPPKRVIQMRCGFAGGVGHQRKRTRRRRLNPGDETQGSRPEEGDPERKESQAGKQGRRRGSV

SEQ ID NO: 779935 - protein, 34 aa, Homo sapiens
RTPAVPVLAFKFLGQGEVQDPRGAAQVAKEISGS

SEQ ID NO: 779936 - protein, 66 aa, Homo sapiens
SLQPPFIPSGPAVLQSVQAASVDLQRCSQYCWVDLGSPWVYCLPGIPGSDFQTLVVNVEHYPSSFI

SEQ ID NO: 779937 - protein, 112 aa, Homo sapiens
ASLLCMAMPFSLFSGFHILCTIHSFREHLLRTYNMSNTIKGQGDTKMNKEWTLLSKDQEAERQRKDDDFDDGDDDDDVQGICTMIIDLYRILRAERGTHSLCSKSQLNTPLL

SEQ ID NO: 779938 - protein, 54 aa, Homo sapiens
MSTSAVLSFKKFKENKTRGPQGCTGKQTSNRTGTMAEAHAGHQNREWTRPHGEA

SEQ ID NO: 779939 - protein, 108 aa, Homo sapiens
KTVAIKRADMLKYVIKRYRSFLPEIFKKASDLPELVFGFYLKELDPAEHSYVLIRKIDPALVWGLTGDQGTPKTRLLMITLDSIFMQASCVPEEVVWEVLRVLEAHFV

SEQ ID NO: 779940 - protein, 108 aa, Homo sapiens; identical to SEQ ID NO: 779939

SEQ ID NO: 779941 - protein, 48 aa, Homo sapiens
MTGKATSYHPVKGEGWASCSQEVAAKRGPESAGLLSKELTAAETLNPS

SEQ ID NO: 779942 - protein, 139 aa, Homo sapiens
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDIGGRG

SEQ ID NO: 779943 - protein, 64 aa, Homo sapiens
CGNLATSLNDPLHTLPGPGCLHQHTGCVESSSPSDQGHCCSFSVSPQNMALEEAAQLTETWQVA

SEQ ID NO: 779944 - protein, 103 aa, Homo sapiens
DTPLGSANYLGCTAAKLHRQPPLLQSSPDFFLICYLSRRNSRKSTRAFPANRVRLISQTPAPSTKQQLFSFLGMVSVVGILTQEPGPHPVAFLSKQLDLTVLA

SEQ ID NO: 779945 - protein, 71 aa, Homo sapiens
MLNISDLKLVLHTVCQPYIVSLVSALPHCITPSCFFSLFLLSPPYYSLAIVFFPLDHGNAGILLSGVSFHV

SEQ ID NO: 779946 - protein, 121 aa, Homo sapiens
KEAGSNRQASKIPRGNDVRATPVCVPGDNLMKKANLAPYPKGEPWHEINLPGSPQCKLAALSDASTIPGSSEGGGYYPHLTDGNAGPERIVAQLRNQHPQLIFIISQKHAARSVNETPSIQ

SEQ ID NO: 779947 - protein, 99 aa, Homo sapiens
CLLVMYAQWEKLMEVCSNHKQSEISRVQNSQKSRFGSLHQVKNSGQLSNMDVAVEADRTLYNVHTSPNIQNYCSQWNCLPLRKSGNSGNPRTRYHGTYL

SEQ ID NO: 779948 - protein, 72 aa, Homo sapiens
LRRLILVFGHHRAFPSNLIQAKTIFRDKNLNRFSRVRWLMPVIPVLWEAEAGGSRGQEIETILANMVKPCLY

SEQ ID NO: 779949 - protein, 72 aa, Homo sapiens
VVLVSLELQLDPSVPHAQGAREVPGNRPIQALQVHPDIFALLFRQCKGSPFFPFVTWAFCILFKSTFSSYIF

SEQ ID NO: 779950 - protein, 82 aa, Homo sapiens
CLCGQNTPSELAEPALSPNPTLPGPKRPKRKREAAALVHSGVNTLQALRFLQDQHRRSHRSHTRLLSDPEGGAVWNSIFTHV

SEQ ID NO: 779951 - protein, 41 aa, Homo sapiens
SHTLVSHAASVLQAKKLRPAAVQPGLKQRLLDSGHLSYQPP

SEQ ID NO: 779952 - protein, 102 aa, Homo sapiens
CFTMAFTPARHLCIKVFTDPKIRLSRFSSCSFGPLPWWSQPPQCCPRVSLVITVPCPWCPGARPPSPAVDMPTNPKAPLSAQHRPRSSPESYSLLDVPHRLI

SEQ ID NO: 779953 - protein, 127 aa, Homo sapiens
LIRTLFFQTASFSHRSLYHSDHCPLNLLPHPLFHPDEPGFTVCGTSGHGTKWFSTLLLSTGLLVLFLDTNPGINVPFPSKGPHCGFLSTLLSFLLLDLCLTTFPGSLCFFILLFSFSPGAFVSGFLC

SEQ ID NO: 779954 - protein, 81 aa, Homo sapiens
SSPSSSLSLPSPSPPLSLSSSPFSITIIIIIIIILIPIIITITTVIAVIITITINVVITIIITIIIITIITITIIITVIIT

SEQ ID NO: 779955 - protein, 325 aa, Homo sapiens
AVRRLRLEGTGGEMSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFGDTVQGEVRVCSSVQEAVAGADVIITVTLATEPILFGEWVKPGAHINAVEPADLTGEKLDDELMKEAVLYVDSQEAALKESGDVLLSEIFAELGEVIKGVKPAHCEKTTVYKSLGMAVEDTVAAKLIYDSWSSGK

SEQ ID NO: 779956 - protein, 270 aa, Homo sapiens
MQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFGDTVQGEVRVCSSVQEAVAGADVIITVTLATEPILFGEWVKPGAHINAVEPADLTGEKLDDELMKEAVLYVDSQEAALKESGDVLLSEIFAELGEVIKGVKPAHCEKTTVYKSLGMAVEDTVAAKLIYDSWSSGK

SEQ ID NO: 779957 - protein, 69 aa, Homo sapiens
MGTDGRRAQSQGSPTAPRLLQIVTTTPAISGDFPENSEHGVPDSVSQSWDVIWCQPFRGHWGQHPHLRV

SEQ ID NO: 779958 - protein, 110 aa, Homo sapiens
KAQRDETAYQGCHRSYVMESGNQTQARECHHPSHLDFCYSHLILLYLISSQLPAARVNCMYNGSCPPLLRAFQQFSPHSQPSSSSHLTHKSQRLMWPTGPRGRALLLLYP

SEQ ID NO: 779959 - protein, 49 aa, Homo sapiens
ERPSVGFERKQEIEELQDASEREERGDVEEQIGSPRGHHKGSSGGEAGQ

SEQ ID NO: 779960 - protein, 98 aa, Homo sapiens
GGWLVRGYDSGPALLAATLAQASLRTAWMSGTPAVLYWPPGTLPILSGHGQSHHGQRQGWVQPRAAREDQAGLLPPPSAVRSCWVQVVPSPLFSGKLI

SEQ ID NO: 779961 - protein, 101 aa, Homo sapiens
NFWALELSEGVSKRQVCFLPAPSWNILMTVSHQSNPSPVAYQAPHWDETHATLPQASQGAIHAVPHPWLAVLWCFSPSAQLLCPHEPGAFCIKDAMISVPH

SEQ ID NO: 779962 - protein, 101 aa, Homo sapiens
YQDSCALGRRKSHRRTEGGNRPQTHRRRKRHRRTDGVNRPQTHGGRKRHRHMDGGNRPQTHGRRKHHRHTDERNTTDAGTEETPQMHGWRKRATEARTEKT

SEQ ID NO: 779963 - protein, 117 aa, Homo sapiens
LWVRGWSSCGDIQQTIGSLGLEFKSKARARTRATDLRVFGTEVIVAAEEVDEVAQSEKKNQKAKGSTFREVYISGSREEKECLEMRPVGVVRKGGEEPGEGGAAKAREKGASPESRN

SEQ ID NO: 779964 - protein, 90 aa, Homo sapiens
LCGPLRSSQPPRSRCSCGSAALPGGLRDQREAGAQGLSTGKPSALGSGGRVQQPSNPGGAEGGLVSVSSRRTPSWSCKEPAWSKLEQGRG

SEQ ID NO: 779965 - protein, 125 aa, Homo sapiens
PEKRQVKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQER

SEQ ID NO: 779966 - protein, 134 aa, Homo sapiens
MTRNDGNPFVGTHEDENDSPKMPRDKQKHGHIHMRGDLAASTDTQTGAAPTLTASNGARNSTRGSPPKARKQRATDKQKKPSGLGRPARNQTNKRESRAGHKHEKHKKRGRKSTREHKLQGKHTSAGRRMKSNM

SEQ ID NO: 779967 - protein, 53 aa, Homo sapiens
YSSTLLLQSHQEVHNSVEDTLTKKQGDKPQSCVPQSAGITGVSHHGQLHKPTS

SEQ ID NO: 779968 - protein, 66 aa, Homo sapiens
GGGCRLSPGNPSTWEAEGGGSQDQEIKTILANMAETPSLLKTQNFAGRGGMRLYVPATREAERLGL

SEQ ID NO: 779969 - protein, 144 aa, Homo sapiens
MSMLGPQKRLASSVLRCGKKKVWLDPSETNEIANANSRQQIRKLIKDGLIIRKPVTVHSRARCRKNTLARRKGRHVAIGEQKGTANARMPEKVTWMRRMTILRRLLRRYRESKKIDRHTYHSLYLKVKGNVFKDKRILIEHIHS

SEQ ID NO: 779970 - protein, 144 aa, Homo sapiens; identical to SEQ ID NO: 779969

SEQ ID NO: 779971 - protein, 144 aa, Homo sapiens; identical to SEQ ID NO: 779969

SEQ ID NO: 779972 - protein, 167 aa, Homo sapiens
GGTISIIQTWKLRQSPAGRIEQAPAGWAQGRDPALSTSALRDGLSGSCLPPLPTCFPTPGPNSHLGAPHGFPSSSPRLASDPSCTKPSAFSIPSSSPSIPPLLRFPWQPHPPLCHSVLPSHLISFFPLSSLPSSQCTVQIPLCPLPLLSRSLLLSFYLLQCSLVISG

SEQ ID NO: 779973 - protein, 81 aa, Homo sapiens
RKVEAVWEEAGSGPAAGPALLPPLASRLPGVVRNPRHVLWGLWQGRGTLEPAPCALRAVPGQGNSSCPLRTTRTEGWVHPV

SEQ ID NO: 779974 - protein, 68 aa, Homo sapiens
DAGPGLQQPYQPLQLRGGSGSLRLRFLSRSVLPIPFGLCLHRRLCNPFPVGESLLRCSGVSVFWLNSD

SEQ ID NO: 779975 - protein, 101 aa, Homo sapiens
LTLIQGLSLSRSHRQDRAGTQGPQHKLQRPPRLTLPQCAHKDRTSTQFTPRLETLGVLPLISPEPPHKPCKLCEGQLGTAESPATSPCPGWDWAGGATSYC

SEQ ID NO: 779976 - protein, 131 aa, Homo sapiens
MLWKVILDSSPSESMLDSSPSVWAVFYNGDICVMGLFIYPLCTRLPTHLSIHSPIICLSIYLSIHPAIIHLFHPLFHPFTFPSIHPSSVYPSIHPSSIIHPPTHPSIHLPTQPSIHPFVHPHIHPSIHPPI

SEQ ID NO: 779977 - protein, 75 aa, Homo sapiens
KQPCQQPVPELGSRSPRRHTLSLYVDRQQSHSVLEKEPCVSHSLSFQHRHRHPNVPFTGRYSLQPSNCLQPPPPL

SEQ ID NO: 779978 - protein, 113 aa, Homo sapiens
MWIPCCSVWLIDSSTCIPRSFVEMLKLSSHPRATESEYVVCVHVKVSDAGYHPWFLVASFRKSCYLGWILHCPLPVALKIYSVTWNTEYFPGVHYCDLTLGRHKLDEGEIASR

SEQ ID NO: 779979 - protein, 148 aa, Homo sapiens
GDLPTSASQSAGILGMSHRAWPGSSSSSTQICLTLSTLWLRSSFFFLFCSAHLAYDFNHHFSEHGSGSTSLLNFRPTSLATWWRPPQNDLLLPKSRLSKLQSVSPPEAFPQAFLFLPSIPHSPTLPCQKPAGQLGFLFVLFFLYFAGA

SEQ ID NO: 779980 - protein, 74 aa, Homo sapiens
PGLQLQDTHIRKTPAPPGFYSCMTLKLKNTRCSPGLQLHEPQTRTTSAPPRVFSCLTLKLEQHQLLSKSPDHGP

SEQ ID NO: 779981 - protein, 113 aa, Homo sapiens
SYYTFSKLYTSQRLYFLKASYFSTLYTSQRFILLNALYFSTLYTSSTLYTSSKLHTSQRFILLNALYFLNALYFLNALYFLNALYFPYYHSALRSCLGWRNVFIIRTLSGSSL

SEQ ID NO: 779982 - protein, 70 aa, Homo sapiens
KKSLMPKPISIQHSSGHMIGHWMSHDLSLAGNAGMHSVFLWVWHCKEMRFGTTTTTGGQPGATGLTARSR

SEQ ID NO: 779983 - protein, 130 aa, Homo sapiens
WLAVCVSMLLLYDSVCVSGCVCVCVSLCVSPIRSSVSVPRSLCVSFPLSVGLCVCARVRVCLWPNVPCAPQSGFWHGGRSLVSLFLRLCLGHEGRLSIVFTAPDPLCVCEDLAHVRRCVGPGATEISSPS

SEQ ID NO: 779984 - protein, 112 aa, Homo sapiens
AYTTKGMVAQRSPKCHSQGSVPGRPTMMIRTRPMTLRLLQCTHPRLPGELLGYRLQYCGADEARPNTIDFGKDDQHFTVPARAHFLLFCRVPQSVLHLCVEPHVKAIFKTTN

SEQ ID NO: 779985 - protein, 102 aa, Homo sapiens
MKKRHREGCDMPGPWSTLRSHRGHHCPHLHPVLRRPTLTDVEGCLQCLDVCGHPRHAVDAHLLHASALDLLHALAHDVGHLGPLSPAGGGNVLSVLTALLGP

SEQ ID NO: 779986 - protein, 141 aa, Homo sapiens
MLCPLLSRAGMASSRKKYSSTSTCPRGVGKRRVAQRGAHSCWWEVFGAQAPKSTSGARNPCWCHEPLTVRRGWGGVLTRHDLLGGGWLFILEMHRALLCPPGWSTVAPSWITAASNSWAQAILLCQPPRYLGLQICAPMPA

SEQ ID NO: 779987 - protein, 141 aa, Homo sapiens; identical to SEQ ID NO: 779986

SEQ ID NO: 779988 - protein, 131 aa, Homo sapiens
MLLFSLSQVVRRVYKECLGSPAGAGRWGSERSCASTCSGRESPVSRPGPFLTLHVSCSPETSEPTPENSGARRLEEDQMLPGHGLSRITFQHLIRYLDLLGKKLETMYKTYKYSSIKRLFRMKVLKQVISK

SEQ ID NO: 779989 - protein, 669 aa, Homo sapiens
GAEASASEVQHHVLGHSQREATPGPSEQPLLTSGVTLPSTHCPTMAGDRLPRKVMDAKKLASLLRGGPGGPLVIDSRSFVEYNSWHVLSSVNICCSKLVKRRLQQGKVTIAELIQPAARSQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRFMRVPINDNYCEKLLPWLDKSIEFIDKAKLSSCQVIVHCLAGISRSATIAIAYIMKTMGMSSDDAYRFVKDRRPSISPNFNFLGQLLEYERTLKLLAALQGDPGTPSGTPEPPPSPAAGAPLPRLPPPTSESAATGNAAAREGGLSAGGEPPAPPTPPATSALQQGLRGLHLSSDRLQDTNRLKRSFSLDIKSAYAPSRRPDGPGPPDPGEAPKLCKLDSPSGAALGLSSPSPDSPDAAPEARPRPRRRPRPPAGSPARSPAHSLGLNFGDAARQTPRHGLSALSAPGLPGPGQPAGPGAWAPPLDSPGTPSPDGPWCFSPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 779990 - protein, 95 aa, Homo sapiens
LPCSLPSLRRPRALHQSHRMEEQELVCPGEVRPALHQLQAPNLGGKEGTPLPVAPELFSGRGGQALGFMVPGCSEGLRNRTVCVGASGRGFWNVR

SEQ ID NO: 779991 - protein, 107 aa, Homo sapiens
ITSEFTSNGPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 779992 - protein, 557 aa, Homo sapiens
MPEALNGPQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRFMRVPINDNYCEKLLPWLDKSIEFIDKAKLSSCQVIVHCLAGISRSATIAIAYIMKTMGMSSDDAYRFVKDRRPSISPNFNFLGQLLEYERTLKLLAALQGDPGTPSGTPEPPPSPAAGAPLPRLPPPTSESAATGNAAAREGGLSAGGEPPAPPTPPATSALQQGLRGLHLSSDRLQDTNRLKRSFSLDIKSAYAPSRRPDGPGPPDPGEAPKLCKLDSPSGAALGLSSPSPDSPDAAPEARPRPRRRPRPPAGSPARSPAHSLGLNFGDAARQTPRHGLSALSAPGLPGPGQPAGPGAWAPPLDSPGTPSPDGPWCFSPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 779993 - protein, 111 aa, Homo sapiens
MPEALNGPQVEATEPQDVVVYDQSTRDASVLAADSFLSILLSKLDGCFDSVAILTGGFATFSSCFPGLCEGKPAALLPMSLSQRSAAPQPPGLFCEWFLSRQHGSQASRDM

SEQ ID NO: 779994 - protein, 204 aa, Homo sapiens
MPQAELGIQVCTCRLRGSVSRCCSHREFRRQPSPCAAGIGLLHLGSTASRQVKPPRLPPPPWGRSGEKLPFTPFPGCSLSRWHASPQTQVAFGPRWVSLLPLPHTPSGHWDPCPSDVLGSRSGASHCGKRPGAWPERQPRAGPSPESWSRAREAPIPPRPAALSAVSSICSSFHPQLCVPVIPPFSKSPVPVPSVPTHSCSPKK

SEQ ID NO: 779995 - protein, 165 aa, Homo sapiens
MPEALNGPQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRPQGVFQVRKLLCRQPGPGWKTSLGYL

SEQ ID NO: 779996 - protein, 103 aa, Homo sapiens
CIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAE

SEQ ID NO: 779997 - protein, 106 aa, Homo sapiens
PVSVPQVAGTEGMSHHTRIIFVFFVETGFHPVGHGGLKLLGSSNLPSSASQSTGITGMSHCAWPFFTFIKNGGGTLQVSSPTSDLLTSASLGMAPPVPGSQIWFSV

SEQ ID NO: 779998 - protein, 179 aa, Homo sapiens
DLVHHFEKGTKLGETFDSDSSEMFLSVEAKRYKIYPLALSPIYEDDSSQEDILSSEVSPGHHGPRKSRDSENQSSSVLSLLQSVSERLKMNFDEDDREAADEEEEEEEAAVLHKGDLRAGSGERVTFQLPDPSITFYPDDQESVGISKNSYVMPNEPTTSNLQVGLWPEKTSFLQKSDL

SEQ ID NO: 779999 - protein, 60 aa, Homo sapiens
MGNSGIGKPAGGGEDSEESDEEVNEVKCQLSANMRLRQAYSLRAPGSRPLPGLPVSVSPY

SEQ ID NO: 780000 - protein, 443 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLNIPSGFFTMASMSHSTPLSAKTTTSVLPSPCARLKTWSAL

SEQ ID NO: 780001 - protein, 441 aa, Homo sapiens
SAPHEESMRYFIKSMEHSVCPSSAVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLNIPSGFFTMASMSHSTPLSAKTTTSVLPSPCARLKTWSAL

SEQ ID NO: 780002 - protein, 308 aa, Homo sapiens
MSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLNIPSGFFTMASMSHSTPLSAKTTTSVLPSPCARLKTWSAL

SEQ ID NO: 780003 - protein, 170 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGA

SEQ ID NO: 780004 - protein, 405 aa, Homo sapiens
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLNIPSGFFTMASMSHSTPLSAKTTTSVLPSPCARLKTWSAL

SEQ ID NO: 780005 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 780006 - protein, 67 aa, Homo sapiens
GKGACTQEIESSLGKTVGPPSHYLSWLWWCTTVVPATWETEVGGPPEPGKSRLQGDMIMPLHSSLGD

SEQ ID NO: 780007 - protein, 85 aa, Homo sapiens
GDAPCQETDFVSASALGVKLRTGLAPSLIVSSERIADQHTHLSAAKGVQQLLRIRRVHKAGHALAPRSELPEGRGFVVFFQLSHP

SEQ ID NO: 780008 - protein, 95 aa, Homo sapiens
CRPSRLSRGKEPHQGQHCATPNKAGNLACQWRPLFRLGSSSRARPVTSAPPSNTRLHMGTASLNCVVAGGLERCCHHCTWTHHQPLSVTCPRAFR

SEQ ID NO: 780009 - protein, 128 aa, Homo sapiens
TGATLLHQPPPPHGSLNPVTTSGAAQVGWGGGGDRERASERHSLSHQFWDRTGPGCLFLMYVKEMQTDWERTEVLSPTGYGEKVRVAYQTNSKLQTSFSSAYMHSKLHAYVRSAPARQRVSFLSISNL

SEQ ID NO: 780010 - protein, 448 aa, Homo sapiens
MDMGTQWAKGNPWHRAKRRGLPQIKKRRGGPRVFCPIPEGVFEANGVYTGGQGSRIYDRPARGTTYQKAKREKEEKEGEEKRRDKREAKGGRRENKKEEEKTSKTQDTDTRIPTSTKPGLGIAEEAHTTSKEEKKKYETTRQREEAGEERKKQEEEKKEERDSRRGREEKKAQRGETCGKSGEKEREDMRETNRRKEQQEEARGSERETEQTRAKREEIESERGREEGETIRERQTSGTERQQSQARQRHEQDDVIEPRQAGQRHMRRREERKKQRRGERLDHGQHMTEDHEGAQRYGRTRERRRRGPDRTRDEDTRWENERPGQEEDGRRRERKRTTGEVDNETTDGEKTEEETAKRKRDEEARNDEDRKRKKADRGPTGESRRARARRNDGERETTREATAREKRRADKSEKKGTDAEETDREEREQTGQEEGEQREKTTERADRS

SEQ ID NO: 780011 - protein, 102 aa, Homo sapiens
MPMLFPGACCLSPHPLPHRLYGLRPDLMHQARVSCRDPGCTPHLAQTNQTHQLLSFPISVGEPGTTQMTGLEVDSHSPLLTPLSSHPAHPARQVLSFHLLNL

SEQ ID NO: 780012 - protein, 28 aa, Homo sapiens
MRVEGLGCTVESALPGQGVGHSSHHKTP

SEQ ID NO: 780013 - protein, 136 aa, Homo sapiens
MRQAHSGSTHKRQIPTLSEGAEHTRSRREEKTHDGHHNNDLEEQKLTRRRAPQTKKKQGTAGHHRHSEYEEVAALERQNKQQRTHNQSGEEIKPHYYLAEKTPTKGSLTHTQEEDKTRTNGVGTTHKRINNVGRPP

SEQ ID NO: 780014 - protein, 107 aa, Homo sapiens
SHSSQTEISTKKVGSIVFSLMCFPFQPESRAPAPSFIVISHSDLFFLYFKHPSLLHHSAFIFAVLCLEQFCPRASITVSSSFWSKLRHDPLREAFPDHTSYCHILTE

SEQ ID NO: 780015 - protein, 53 aa, Homo sapiens
MLGASIELEMIGMAPKSGCYVLKIGDNGKPSTLVLTDFNKVQFTEIEGRKRKR

SEQ ID NO: 780016 - protein, 69 aa, Homo sapiens
MNALDGVPFKLPKGFVIGTEPLPGPELSVPACGEVLLGSMHDFSLERTALFWVEAAGQGPSPYQCGDPG

SEQ ID NO: 780017 - protein, 109 aa, Homo sapiens
MVPVTFAMHPFNVIISCCSRTLQTPGEVGVGVPREDTGAEAGVLPWAVRELVRNRVVGDKVGPGCLVVRLVTGEVGIPVTPEVSDTKPDVGTRVVREVDREVVDEGLPS

SEQ ID NO: 780018 - protein, 112 aa, Homo sapiens
MGGDWGSGKAFSLRVSGSWVSLHGLPQCPAEVPEKAGLRGRGAVCGAQSPNKPQFHGNHYTHSSRRCRGRCFLVHPTLSRDRPQIWAQDFVQGGEMQVTSPYSSIKPGLKMG

SEQ ID NO: 780019 - protein, 37 aa, Homo sapiens
IAKRPIYEGVQFSTIWEKYSRTLVQQCVSKTLIYHCS

SEQ ID NO: 780020 - protein, 115 aa, Homo sapiens
MQLDIQARYIYGKPVQGVAYVRFGLLDEDGKKTFFRGLESQTKLVNGQSHISLSKAEFQDALEKLNMGITDLQGLRLYVAAAIIESPGGETDETERWCALGGLERPRENKQRPQK

SEQ ID NO: 780021 - protein, 128 aa, Homo sapiens
MLGEPTQHTTGTGKMSSKAWLSSLKLLPRQKESSYKLHQTSLQTSLLQGAFGSQDGRGPGDREQDHLLAGVRGRRAREAGSPLLRQLQGHAGWGPCKAGNPGYWQTSPIFSLRRKESSTEQARPAPGP

SEQ ID NO: 780022 - protein, 124 aa, Homo sapiens
MTGVSCFCHYTSHPLHHLLCSYKDPKKWNHRIADLRKQTEELSERKYDHELYEFNQVKDYKLINQLCQLELKKPKVPVMIPYPLIQSHVEDFMEKAFSKNNTTGGTPAGEATSTQLATNRRSQK

SEQ ID NO: 780023 - protein, 87 aa, Homo sapiens
MEKACLILPASVRRRWHRALLGELEQQFVRWQRKNKCRYKFTIRLWPGSSQNKTEPQGPGKGPPCHPWEVRRPRRGRQDVRDSQIRV

SEQ ID NO: 780024 - protein, 71 aa, Homo sapiens
SFITSHYWFRNYNHVVFSKGKSLFKNASGSCSQVETVCASLCVCACAHARMEATVHAGLCTCVQVHETQDF

SEQ ID NO: 780025 - protein, 113 aa, Homo sapiens
MNKDSLEVRSKMESVRSDLFHCHHVLITIFASVLSKLPPGCLFNSPFTPPPKSASPSRIQATDSHPGSRLLFQMTTFLRELNERICSEWSLPISSFSWHPLPKPWHMDILGLC

SEQ ID NO: 780026 - protein, 31 aa, Homo sapiens
MCLQEGAVTVPHSDFHWVFSGWWWRQLTAAG

SEQ ID NO: 780027 - protein, 248 aa, Homo sapiens
YREADDRLRPYQGCTCHILERLHKKPLKIGALWASGIQRDIFWKLNTQEGRIEPVYADVIHTVGPIARGHINGSHKEDLANCYKSSLKLVKENNIRSVAFPCISTGIYGFPNEPAAVIALNTIKEWLAKNHHEVDRIIFCVFLEVDFKIYKKKMNEFFSVDDNNEEEEDVEMKEDSDENGPEEKQSVEEMEEQSQDADGVNTVTVPGPASEEAVEDCKDDDLKGRNYYKGGEVKIILCVTKIIAKDKR

SEQ ID NO: 780028 - protein, 130 aa, Homo sapiens
SQDWSRSMDSAHGILPSLALKRHCHTNGPRVHSPVVNIDGRVFVWAHSCFSWVNTQEYMAFEVVRVTPPPLESGVPSYRPAPGVCGSTPHGGTGVPRGALLLNPARSVPVCRHSQAEPRTLHARLQTFSG

SEQ ID NO: 780029 - protein, 558 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 780030 - protein, 133 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLAPFLTDIPSHELSLCK

SEQ ID NO: 780031 - protein, 536 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 780032 - protein, 590 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRWGKWTLKRSILECSFSVFTSRFYIHCVKMWTLKYDVRPICTFISLLISSPCQIN

SEQ ID NO: 780033 - protein, 106 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGCTPVVSLLVRRTGRSY

SEQ ID NO: 780034 - protein, 492 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKNKWRN

SEQ ID NO: 780035 - protein, 468 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 780036 - protein, 634 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGEPGARTPVAPRALSPRRLRPAALPVELLGSRSVGTGVRKSIHSFQRVFGGQAERVKLPDGCGRCALSLFPSSLHTGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 780037 - protein, 319 aa, Homo sapiens
SGGCPGDAGTQRSGSRRRPSRRHDRPLGGLAGRAASPQSSRRADGGGGAMSQRQVLQVFEQYQKARTQFVQMVAELATRPQNIETLQNAGVMSLLRTLLLDVVPTIQQTAALALGRLANYNDDLAEAVVKCDILPQLVYSLAEQNGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 780038 - protein, 106 aa, Homo sapiens; identical to SEQ ID NO: 780033

SEQ ID NO: 780039 - protein, 117 aa, Homo sapiens
SFLLQTLIQTTAHWSGQGGRAEIGKPMFQPRFCHNLCGNLPCAGPQRPLCTLSGPTSCPPDPFQLSNLTGSGLTAEWKIPSDFGLLCLFGVWLHRQEPVEDVAFHGSFNQRLTSILS

SEQ ID NO: 780040 - protein, 152 aa, Homo sapiens
GVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGEEADIVLGQVHSCGY

SEQ ID NO: 780041 - protein, 145 aa, Homo sapiens
GQISGCWAVMALLDVCGAPRGQRPESALPVAGSGRRSDPGHYSFSMRSPELALPRGMQPTEFFQSLGGDGERNVQIEMAHGTTTLAFKFQHGVIAAVDSRASAGSYISALRVNKVIEINPYLLGTMSGCAADCQYWERLLAKECR

SEQ ID NO: 780042 - protein, 84 aa, Homo sapiens
PTTKPWQAVDAGTANSLSIPVSEETCFEGCTTWICFYSGVCHYEDSTMGRHQVRDPDKARTASSSAHSSAPFPAMPNTKPSPEG

SEQ ID NO: 780043 - protein, 489 aa, Homo sapiens
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMRYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 780044 - protein, 206 aa, Homo sapiens
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGARDPSRWGEGSRIGSGARAGCSACSHSLPNQCFKEMARSFCVAILGTPRSSQRPLSSIERE

SEQ ID NO: 780045 - protein, 579 aa, Homo sapiens
MGGRLAGLRARETRRAGGIEEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMRYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 780046 - protein, 624 aa, Homo sapiens
MSWKSSLPTFFCHIYSFFHDFLYWLCGKSVKSCTTSGNSFFKQEFIILGMMAFMDFSVTMMALSLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 780047 - protein, 33 aa, Homo sapiens
STSVCFWEGLGKLTIMVKEKQASHMVEAETRKM

SEQ ID NO: 780048 - protein, 873 aa, Homo sapiens
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKALLDTQNLLRAQITNFTFNLGFSGKFYHTGTEEEDEGDDCLLGSVDEFWWFPHMWSHMQPHLFHNESSLVEQMILNKKFALEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVQFFNRNNYHRGIDWYMDFFPVPSNVTTDFLFEKSANYFHSEEAPKRAASLVPKAKIITILIDPSDRAYSWYQHQRSHEDPAALKFSFYEVISAGPRAPSELRALQKRCLVPGWYASHIERWLVYFPPFQLLIIDGQQLRTDPATVMDEVQKFLGVLPHYNYSEALTFDSHKGFWCQLLEEGKTKCLGKSKGRKYPPMDSDSRTFLSSYYRDHNVELSKLLHKLGQPLPSWLRQELQKVR

SEQ ID NO: 780049 - protein, 95 aa, Homo sapiens
KVQEMGSRPSRRKVSLQSPGLYSENKGCANEVLTGEFLLPRNLPAWPAGTLTLHQAEPAVAQPGSTEDVRGHPLYWEEGWSHQLQRGPASAGGWF

SEQ ID NO: 780050 - protein, 67 aa, Homo sapiens
CKIKELNKDSGFQTGFRGTLGFQEDMMVRRARQKGKKTIVNEQDPHFYPDCSFLLCFVYHASTQYYT

SEQ ID NO: 780051 - protein, 58 aa, Homo sapiens
KWQLAKTRTNAQRVEMDVWIESWQTAGQTVSPGSLLRGHTAKPTCISESLRTETQPPP

SEQ ID NO: 780052 - protein, 46 aa, Homo sapiens
MCTQKTEECYSRTELLKPGAILPNPWLRSLRLETWALSTGSQSSSF

SEQ ID NO: 780053 - protein, 1136 aa, Homo sapiens
TGGENPLLFFLSLFFFLRRNLTLSPRLEGSGEISAHCNLHLPGSSNSPASAFRVAGITGARHHAQLIFVFLVETGFYHVGHAGLKLLTSCDPPASASQTAGIIGMSHCAWPTIPFKGRWCLQHQGHTAATPLQVPGLPDNHDQLVPDNLEAWALAGPRGLFPKRTLVIWKRIGAGLVVTVALLPRMDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFIPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 780054 - protein, 1091 aa, Homo sapiens
SVPPRLPDSYKGGRRRRAATGLRPPGNPLSWMLFEVGEGGGAGEEGKGRGRPGRSLCTHAAPARTAHLAPSALRSARPFLWEDNLLTRSQGLPDNHDQLVPDNLEAWALAGPRGLFPKRTLVIWKRIGAGLVVTVALLPRMDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFIPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 780055 - protein, 173 aa, Homo sapiens
METKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 780056 - protein, 1091 aa, Homo sapiens; identical to SEQ ID NO: 780054

SEQ ID NO: 780057 - protein, 97 aa, Homo sapiens
KKTRNAHHPGAEKLMSSSLAHQNYQIKKQNKMCACTRFRPWTHRHFQKFSWNPIQIPKMQNFPETSLEFNSCPNPKLQNFPEISRGSTGERKLRPHI

SEQ ID NO: 780058 - protein, 65 aa, Homo sapiens
GAEEYGKPGGKKVVLEPEEPAQARAEGVRGHDGEEEWHFYVIMPDSTERVLCRARPTSSPGKLTM

SEQ ID NO: 780059 - protein, 120 aa, Homo sapiens
RQNRLGITTAGHYPATPDLGQGNSREGRPQGLPSPEVESTGHSQWWGEPGCPQRNGRIQTTTEQKAGGLGVGQGGGAPGSYSQPSAGLGGKFTAPEHSQMGFSPPPKECKPGKGGEIPLG

SEQ ID NO: 780060 - protein, 103 aa, Homo sapiens
EFTSDCELRSHPLQSHQSTLLLKYPQVHSSHFTVTAHECNEGLLPSNLAGPCLALKGTSKQGPFNDPWQRAAKALQCPQSPESGPNPLHLPPSSPHIWHNTLY

SEQ ID NO: 780061 - protein, 109 aa, Homo sapiens
AGKRECQEREGGACLMVHKRCLRWSCSASLSSWGCWGQTGLLRRCEEVSCPRLHPFPHLGRKALCLCRLFRLLRPFSFSVVFLYHRLYPCENTRPGITSWVTCPDLLPL

SEQ ID NO: 780062 - protein, 395 aa, Homo sapiens
WDARGCEPAGHAPRAGSLLAAMKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 780063 - protein, 395 aa, Homo sapiens; identical to SEQ ID NO: 780062

SEQ ID NO: 780064 - protein, 107 aa, Homo sapiens
LLNQQTEKQIVLWLLLPPEGSYLITLAACSSSLRPYRDDTTSHIPFYSPHGTFHHLNAPFLYLCIPFRSGFPLYALPLKCKFLGSRRSIDPTSVQHPPVPTTLPGTQ

SEQ ID NO: 780065 - protein, 146 aa, Homo sapiens
WSLRVGPVNVLSAVYASWSKHAETVPEMSTLAFHSRGRPLGEASNEKCRVSRLLSLRPSGVSFSYLSLGFLICSTGHSSACFAGLSKKTIEPTERASPTERASPHRESVTPQRERHPTERASPHRESVTPQRERHIPHRESVGYRA

SEQ ID NO: 780066 - protein, 101 aa, Homo sapiens
LLLSLPLIAQTVERLQSVIWLGGGSDRASQKMFFLSWKSDTLRNKVLCDRPLTKEESRGLHDDSEAYGQVPPHTRRPVCTIVRQVENFCAYVFPISKRVWH

SEQ ID NO: 780067 - protein, 114 aa, Homo sapiens
WPLSLSEPPFPGLLYEHVDLAPRYPCHDTFSSSSLGQPSHMAFDCFSHYGIWGAVGAQLNLVGEAQECTTEWLSRAFPLPASCLCSPLCQECGPHSSLLVEILVLEALRKCCLP

SEQ ID NO: 780068 - protein, 111 aa, Homo sapiens
LRYRPPVIYICFNANIGKHWAFLKPFCFVLFEAPLPPVMSLSLVLRAGSPDRRPKSLQNERLPPLKEEGVVLLFCFVLFFRPFSFNGPAALCVALFPVNNCLTVLPGGLRL

SEQ ID NO: 780069 - protein, 102 aa, Homo sapiens
AVHSPDRLLVRLIRLRNLRAKFGTGSPEFVDELCVRARSTLATWPTMDIDKDLEAPLYLTPEGWSLFLQRYYQVVHEGAELRHLDTQVQRCEDIRALLQILT

SEQ ID NO: 780070 - protein, 110 aa, Homo sapiens
MVRPGLNRPRWSAFPAQNARRSHKKPSLLQSRSCRSPRLRQGLEQNLTVMNQYQSLKNRIPPRQPHNKPSWRQQLKIDEEPVSKAKQSRSETEGTEGYVQTGSSAGYRSY

SEQ ID NO: 780071 - protein, 110 aa, Homo sapiens; identical to SEQ ID NO: 780070

SEQ ID NO: 780072 - protein, 119 aa, Homo sapiens
NLEINPLTYREQKLEPPHPVARLLEPSEIPPGLQEFRHEPKIEDLSPASTTSSLLRNSKFKVKLSQTFKKTHRLQLYKRRVKQEEVDETRCRTLRTIELVMSQANVSRAKAVRALKEQQ

SEQ ID NO: 780073 - protein, 122 aa, Homo sapiens
MAKYVKILYDFTARNANELSVLKDEVLEVLEDGRQWWKLRSRSGQAGYVPCNILGEELRGELLTQGRAAELRGELQNSGASCWRQQLKIDEEPVSKAKQSRSETEGTEGYVQTGSSAGYRSY

SEQ ID NO: 780074 - protein, 80 aa, Homo sapiens
VRRRLSARLRQGLEQNLTVMNQYQSLKNRIPPRQPHNKPSWRQQLKIDEEPVSKAKQSRSETEGTEGYVQTGSSAGYRSY

SEQ ID NO: 780075 - protein, 94 aa, Homo sapiens
HKNIGQVRGWVALSAAILVPRSLHSLLFIPFLQKCPAKPQETVPATEQELPQPQAETGSGTESDSDESVPELEEQDSTQATTQQAQLAAAAENR

SEQ ID NO: 780076 - protein, 114 aa, Homo sapiens
HKNIGQVRGWVALSAAILVPRSLHSLLFIPFLQKCPAKPQETVPATEQELPQPQAETVAAFPLESADPAGVAPTTAKGSGTESDSDESVPELEEQDSTQATTQQAQLAAAAENR

SEQ ID NO: 780077 - protein, 118 aa, Homo sapiens
TQKYRSGTRLGGAFCRHLGSAFPAQNARRSHKKPSLLQSRSCRSPRLRQGLEQNLTVMNQYQSLKNRIPPRQPHNKPSWRQQLKIDEEPVSKAKQSRSETEGTEGYVQTGSSAGYRSY

SEQ ID NO: 780078 - protein, 118 aa, Homo sapiens; identical to SEQ ID NO: 780077

SEQ ID NO: 780079 - protein, 118 aa, Homo sapiens; identical to SEQ ID NO: 780077

SEQ ID NO: 780080 - protein, 118 aa, Homo sapiens; identical to SEQ ID NO: 780077

SEQ ID NO: 780081 - protein, 118 aa, Homo sapiens; identical to SEQ ID NO: 780077

SEQ ID NO: 780082 - protein, 94 aa, Homo sapiens; identical to SEQ ID NO: 780075

SEQ ID NO: 780083 - protein, 94 aa, Homo sapiens; identical to SEQ ID NO: 780075

SEQ ID NO: 780084 - protein, 94 aa, Homo sapiens; identical to SEQ ID NO: 780075

SEQ ID NO: 780085 - protein, 94 aa, Homo sapiens; identical to SEQ ID NO: 780075

SEQ ID NO: 780086 - protein, 94 aa, Homo sapiens; identical to SEQ ID NO: 780075

SEQ ID NO: 780087 - protein, 94 aa, Homo sapiens; identical to SEQ ID NO: 780075

SEQ ID NO: 780088 - protein, 94 aa, Homo sapiens; identical to SEQ ID NO: 780075

SEQ ID NO: 780089 - protein, 94 aa, Homo sapiens; identical to SEQ ID NO: 780075

SEQ ID NO: 780090 - protein, 94 aa, Homo sapiens; identical to SEQ ID NO: 780075

SEQ ID NO: 780091 - protein, 94 aa, Homo sapiens; identical to SEQ ID NO: 780075

SEQ ID NO: 780092 - protein, 94 aa, Homo sapiens; identical to SEQ ID NO: 780075

SEQ ID NO: 780093 - protein, 94 aa, Homo sapiens; identical to SEQ ID NO: 780075

SEQ ID NO: 780094 - protein, 129 aa, Homo sapiens
MGLPAAWASSIIWIKGQARLRRLTGSSTKGTDSRSSTIADDTSSDKAFNMARARGIILRLNDARLLGDLTQQAKQLVTQIIQKQQIRSNATAQPNRHLTSPRASLVDKSTLADPVVNGLKRAAQAVSMI

SEQ ID NO: 780095 - protein, 94 aa, Homo sapiens; identical to SEQ ID NO: 780075

SEQ ID NO: 780096 - protein, 94 aa, Homo sapiens; identical to SEQ ID NO: 780075

SEQ ID NO: 780097 - protein, 94 aa, Homo sapiens; identical to SEQ ID NO: 780075

SEQ ID NO: 780098 - protein, 94 aa, Homo sapiens; identical to SEQ ID NO: 780075

SEQ ID NO: 780099 - protein, 94 aa, Homo sapiens; identical to SEQ ID NO: 780075

SEQ ID NO: 780100 - protein, 94 aa, Homo sapiens; identical to SEQ ID NO: 780075

SEQ ID NO: 780101 - protein, 94 aa, Homo sapiens; identical to SEQ ID NO: 780075

SEQ ID NO: 780102 - protein, 118 aa, Homo sapiens; identical to SEQ ID NO: 780077

SEQ ID NO: 780103 - protein, 94 aa, Homo sapiens; identical to SEQ ID NO: 780075

SEQ ID NO: 780104 - protein, 144 aa, Homo sapiens
TQKYRSGTRLGGAFCRHLGSAFPAQNARRSHKKPSLLQSRSCRSPRLRQGLEQNLTVMNQYQSLKNRIPPRQPHNKPSWRQQLKIDEEPVSKAKQSRSETEGTEEKKKKKKKKKQKTKKNWGAARPPHKSFSRTQLCVGDRGPQ

SEQ ID NO: 780105 - protein, 118 aa, Homo sapiens; identical to SEQ ID NO: 780077

SEQ ID NO: 780106 - protein, 107 aa, Homo sapiens
SSRSRAAARDLELANARRSHKKPSLLQSRSCRSPRLRQGLEQNLTVMNQYQSLKNRIPPRQPHNKPSWRQQLKIDEEPVSKAKQSRSETEGTEGYVQTGSSAGYRSY

SEQ ID NO: 780107 - protein, 82 aa, Homo sapiens
GAVKRIPVNFYTKQIGVKRRHGRLCPNWVFGRLQELLESLSGNLRISSCVITKPDVYKSPASDTYIVFGEAQDRRFIPSKHN

SEQ ID NO: 780108 - protein, 82 aa, Homo sapiens
IRGRVRPAAQKTTEGSLLRNSKFKVKLSQTFKKTHRLQLYKRRVKQEEVDETRCRTLRTIELVMSQANVSRAKAVRALKEQQ

SEQ ID NO: 780109 - protein, 67 aa, Homo sapiens
YASRGWVQSAEGLKNRIPPRQPHNKPSWRQQLKIDEEPVSKAKQSRSETEGTEGYVQTGSSAGYRSY

SEQ ID NO: 780110 - protein, 94 aa, Homo sapiens; identical to SEQ ID NO: 780075

SEQ ID NO: 780111 - protein, 94 aa, Homo sapiens; identical to SEQ ID NO: 780075

SEQ ID NO: 780112 - protein, 118 aa, Homo sapiens; identical to SEQ ID NO: 780077

SEQ ID NO: 780113 - protein, 94 aa, Homo sapiens; identical to SEQ ID NO: 780075

SEQ ID NO: 780114 - protein, 94 aa, Homo sapiens; identical to SEQ ID NO: 780075

SEQ ID NO: 780115 - protein, 94 aa, Homo sapiens; identical to SEQ ID NO: 780075

SEQ ID NO: 780116 - protein, 94 aa, Homo sapiens; identical to SEQ ID NO: 780075

SEQ ID NO: 780117 - protein, 94 aa, Homo sapiens; identical to SEQ ID NO: 780075

SEQ ID NO: 780118 - protein, 94 aa, Homo sapiens; identical to SEQ ID NO: 780075

SEQ ID NO: 780119 - protein, 94 aa, Homo sapiens; identical to SEQ ID NO: 780075

SEQ ID NO: 780120 - protein, 94 aa, Homo sapiens; identical to SEQ ID NO: 780075

SEQ ID NO: 780121 - protein, 94 aa, Homo sapiens; identical to SEQ ID NO: 780075

SEQ ID NO: 780122 - protein, 94 aa, Homo sapiens; identical to SEQ ID NO: 780075

SEQ ID NO: 780123 - protein, 94 aa, Homo sapiens; identical to SEQ ID NO: 780075

SEQ ID NO: 780124 - protein, 116 aa, Homo sapiens
MKTGFTFAGAARITPGVQKGRINGNKLGALDPKVPATFNKFEREKSVRTLCTKTFHHISEENTVNTNAHQEEDIRENTRVSRRSKKGPKNHTEGKTRCEKKAKREGEEKESRGDYI

SEQ ID NO: 780125 - protein, 94 aa, Homo sapiens; identical to SEQ ID NO: 780075

SEQ ID NO: 780126 - protein, 94 aa, Homo sapiens; identical to SEQ ID NO: 780075

SEQ ID NO: 780127 - protein, 94 aa, Homo sapiens; identical to SEQ ID NO: 780075

SEQ ID NO: 780128 - protein, 94 aa, Homo sapiens; identical to SEQ ID NO: 780075

SEQ ID NO: 780129 - protein, 118 aa, Homo sapiens; identical to SEQ ID NO: 780077

SEQ ID NO: 780130 - protein, 90 aa, Homo sapiens
TQKYRSGTRLGGAFCRHLGSAFPAQNARRSHKKPSLLQSRSCRSPRLRQGLEQNLTVMNQYQSLKNRIPPRQPHNKPSWRQQLKIDEEQQ

SEQ ID NO: 780131 - protein, 129 aa, Homo sapiens
DSFMQGCRYLESAIPRFLPAQKFSLVFKFHVFFLETESDSIPQAGVQWNDLGSPQPLPPGFKQFSCLSLPSSWDYRYLPPHWANFCIFSRDGVSPCVGQDGLELLTSGDPPTSASESAGITGVSHHAQL

SEQ ID NO: 780132 - protein, 141 aa, Homo sapiens
MTNGSRHREHMVNHDKTRLLRQPPQNKYSNPGLTQHTESQTKERSFAEVFLGKRRSRGGASRITYCRHKHNRAKREPRSKQRGQRANLHQAKQSTTTCWKYELGNLQPGRTTRGPGSKTECRTARGGPSAHFTKKCSREVW

SEQ ID NO: 780133 - protein, 96 aa, Homo sapiens
REFKVGALRQELATLLSSVQLLKEDNPGRKIAEMQGKLATVVLGLPAPSWERGGAIRFRRGSRAERQDPQPTGHFPASRRRSENHLSEARRGGLHP

SEQ ID NO: 780134 - protein, 125 aa, Homo sapiens
VGKDVHHTFFDLLGSGPLGDYFKELACKMALELLTQEFGIPIAKTLCYLPWRGPGTAVIPQWQKDELRETLKSLKKVMDDLDRASKADVQKRVLEKTKQFIDSNPNQPLVILEMESGASAKATQG

SEQ ID NO: 780135 - protein, 199 aa, Homo sapiens
RVCATHGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRPVFDETYPDPVRVVSIGVPVSELLDDPSGPAGSLTSVEFCGGTHLRNSSHAGAFVIVTEEAIAKGIRRLVAVTGAEAQKASGKQRA

SEQ ID NO: 780136 - protein, 108 aa, Homo sapiens
MVNQCFGLGDGTCLLSIQLEGPKHVAFGWPECPEAPLPTLPPPPLKEPLTVSPRGSHLMSAMPGVSPSRCVGSFPSCLMLTCGHRGCPHIGAFSSSSCPLCHNGMMAW

SEQ ID NO: 780137 - protein, 108 aa, Homo sapiens; identical to SEQ ID NO: 780136

SEQ ID NO: 780138 - protein, 384 aa, Homo sapiens
EDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTEAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVIL

SEQ ID NO: 780139 - protein, 391 aa, Homo sapiens
EDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTEAGVAVLMEGLAGNTSVTHLSLLHTGLGDEGLELLAAQLDRNRQLQELNVAYNGAGDTAALALARAAREHPSLELLQGVAIQMCWKLPLLPYAHLWTPRMPSHWCFLLILMPPLPQWYDGLVAPRGRCT

SEQ ID NO: 780140 - protein, 115 aa, Homo sapiens
GIDFLSPASLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 780141 - protein, 349 aa, Homo sapiens
MVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTEAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVIL

SEQ ID NO: 780142 - protein, 112 aa, Homo sapiens
THRAEDMMSVPACSGGRNGLKRHSLALWEGCGRGHTPACSALLSLLQASGDNQDPVWRPPADSKHGDADARMAPTHEESRFENTMEPKSRLQDLYTIWEENRDTHACVSSTC

SEQ ID NO: 780143 - protein, 115 aa, Homo sapiens
LFGNNNTAPNVGLREDSEPQRSCPKPEREAEILMFLSAIVMMKNRRSITVEQHIGNIFMFSKVANAILFFRLDIRMGLLYITLCIVFLMTCKPPPPHIWALSISSTSMIKPLMRN

SEQ ID NO: 780144 - protein, 1340 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 780145 - protein, 1048 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 780146 - protein, 1037 aa, Homo sapiens
MTVGFNSDISSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 780147 - protein, 101 aa, Homo sapiens
TGLLGVWGAGPHLSRDTLLHRPCCFHAASKASGLRGHPSGGVSLFQDKPSPLCHLLPTPKFKVTPASRLVLGQKGLARGSVTSAPPAGPRGTLHALPTTDP

SEQ ID NO: 780148 - protein, 98 aa, Homo sapiens
GAGELGEQEEGIEGQQLASSNWATASLNVAGSSLGTSPLESQEKPSSCHKRGFQPHFLTSVLRPPSALTILEQAEILAWVNGAENPAPSPEPRPTALR

SEQ ID NO: 780149 - protein, 91 aa, Homo sapiens
GVGDPQRSLQAGPLREAGSREQNLNSSPGTETEEVEHLWRMADQQAWEWQGAFPHVPTTPRTPFWSPQLMESLGTFFPGLFLQPDHLPGKS

SEQ ID NO: 780150 - protein, 69 aa, Homo sapiens
MEKLESCGSSVKWQVWPEDGISRVPEMAMERHRGQAMPGLCCLCCHQGQPQPSAQASGIFQPTFTHPFF

SEQ ID NO: 780151 - protein, 104 aa, Homo sapiens
GRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQ

SEQ ID NO: 780152 - protein, 105 aa, Homo sapiens [sequence omitted]

SEQ ID NO: 780153 - protein, 212 aa, Homo sapiens
HPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 780154 - protein, 49 aa, Homo sapiens
MPFVPCLAPYTTYTLIPLCQPQNPSSSHLGPHILFCTSLYCHLDTLLTA

SEQ ID NO: 780155 - protein, 114 aa, Homo sapiens
GHTGPAGGHGRGLQWGRPLRVEAPPRRRLGSPWPPIWHMSGSTGNQAYRPGRESQLQWWARCEDSGLRPLMGSWLGSVAAHLPTSCVTRASLPNSPNLSHEAKVPALQGPWQMR

SEQ ID NO: 780156 - protein, 165 aa, Homo sapiens
GLLPSAYICFLPTPLPSPASVSSLCDALPPTPVTFLLRPKAPQHPYLFRTSLWQSQLPASSQLVRRPPHLLDEATNQDTLAPPESHPQGLQTSLQHCQAMFPGPSGHPHPQQWATLPSPPALWSDDIEEMKSPEGNALISPGPLCIPTHRVSSPSCPPFPPGSHL

SEQ ID NO: 780157 - protein, 40 aa, Homo sapiens
KTPLGTLSMGIKGQISGVAAEAQSTKASMLETHSLLHLAE

SEQ ID NO: 780158 - protein, 108 aa, Homo sapiens
QLLLGFNGSPFGYNFSGLALGWSRSLLKCGPRAAHHLWMLPEAAGAQAVVPVTGPHVSYAEVSRECWCGWLLHHSHLSSPICGQPKSSDIVHNDCYETTSLSPCTQAA

SEQ ID NO: 780159 - protein, 68 aa, Homo sapiens
RAGAERVGAPQQHPPHPSTLPEDSRGGSFHQSGRPGQGGMQPMGTMSRGRLRQALVPSPAYPEARSAL

SEQ ID NO: 780160 - protein, 66 aa, Homo sapiens
WDNLLVLDNSSRMGKDTEVYRVQGLRSKSTPSTAQRWRAAPETAVHGAETQHCTNAVLLHLGCLLE

SEQ ID NO: 780161 - protein, 366 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 780162 - protein, 366 aa, Homo sapiens; identical to SEQ ID NO: 780161

SEQ ID NO: 780163 - protein, 102 aa, Homo sapiens
HTCEQLAPIALVSINMLGVDLLPPRLHTFSVLRSRPRVPGHSLSSPRPAPRSLAFPDLTFTWDQVFLNQKQAESEKPRQAVLLASCVFRFISPRYRPGIPNS

SEQ ID NO: 780164 - protein, 107 aa, Homo sapiens
LPHFVQETTVIALHLPQPILSAHLGQGKLSKTYLASPHCPPPAVLLPDHPSIPLHPMSQPAPAPDSAPSCQASACTIPSAWTATPSAQACSPATALGQHLPPDAMTP

SEQ ID NO: 780165 - protein, 58 aa, Homo sapiens
SLGSGGWKSKTVTGGTLSALALGTWCANITAIHPAVLHNGIPAMAKIRLTEESLRSSS

SEQ ID NO: 780166 - protein, 57 aa, Homo sapiens
PYSVSKLSVHFTLTDHLRADQPHFNAHSHTYVRVVATALARHRLRSSIGSPFLGTFC

SEQ ID NO: 780167 - protein, 54 aa, Homo sapiens
SSSHGSSAQAVPSSWATHCTQQHRVLALVSGLPGPYLLHKALPWSFLPSSCSLS

SEQ ID NO: 780168 - protein, 186 aa, Homo sapiens
MAVGGIIIPDTLKCQSEKQNKKKQTKQTMGGRRPSGPRKKLSKEQSGWGRAGRPEGHRWTSGPQTRYPQRGREPGGQGHKRGRGFFSHTYKKKARRGAHPRKPFSETKLPREGGVPRGGPHIQGGTLYISHREGEILQREREDRAKYHSQNYNDPPHPSGGNPTTNSDATTTTTKKDKINQNTSHT

SEQ ID NO: 780169 - protein, 76 aa, Homo sapiens
NEPPQPPVPEPANAGERKMREFNSGPHNPVEETKLICLCPSGHASCQVHLWTGAMLLGFQSWRELPGSGLKARILQ

SEQ ID NO: 780170 - protein, 97 aa, Homo sapiens
PPVGLVVFLSLPSLSGDPDNLLRLLEKGSPRRLGLPPIGSGSYFPSHPKKPRALPLLQLGIAPTKHILPRSPWTPCSEMQKREKKYLSGHKDLAHPG

SEQ ID NO: 780171 - protein, 193 aa, Homo sapiens
SAGLQGMGSADGPGCRKGIGSSGEMGSVDKEGYKKDLGAPENMGSGSKADYRDGVGGSGAMGSMDEAGYRKDLGAPEGISSGSKADYRGGLQDSREAGSGSKADYSGGLKGSREIGSMDETDNRKDLGVPEGMGAGYRAGLRGPGEMGSLDESGHRNGIGGYGEMGSGYREDLGAPEGMGTGSKAGYRDGLRG

SEQ ID NO: 780172 - protein, 158 aa, Homo sapiens
SAGLQGMGSADGPGCRKGIGSSGEMGSVDKEAGYRKDLGAPEGISSGSKADYRGGLQDSREAGSGSKADYSGGLKGSREIGSMDETDNRKDLGVPEGMGAGYRAGLRGPGEMGSLDESGHRNGIGGYGEMGSGYREDLGAPEGMGTGSKAGYRDGLRG

SEQ ID NO: 780173 - protein, 132 aa, Homo sapiens
LGSELGVPRSPTPLWGLSATTQQMEPQGDGGWGDCDGVGEPEGEGLGVAVSVRPREGGQVSKRASRAWWLTPVMPALWEAKAGRLPDCLSLGVQDQPGQHGGTPVSTKTTKISQAWWCVPVIPATWEAETGE

SEQ ID NO: 780174 - protein, 210 aa, Homo sapiens
NGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITNLLYHVVGWTELEPIIVDITKHTFYKQPMFYHLGHFSKFIPEGSQRVGLVASQKNDPDAVALMHPDGSPVVVVLNRSSKDVPLTIKDPAVGFLETISPGYSIHTYLWRRQ

SEQ ID NO: 780175 - protein, 122 aa, Homo sapiens
NGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITVSHPSLPSCKGDLRPISSLTKD

SEQ ID NO: 780176 - protein, 142 aa, Homo sapiens
RAPPFHTRPIISYIGWLTSLYTTREQEGVQGGTSEEAHPSPFAPWRQEVTRQQQKTPMPEAGLRCRKAGKFIPEGSQRVGLVASQKNDPDAVALMHPDGSPVVVVLNRSSKDVPLTIKDPAVGFLETISPGYSIHTYLWRRQ

SEQ ID NO: 780177 - protein, 154 aa, Homo sapiens
MSATRAKKVKMATKSCPECDQQVPVACKSCPCGYIFISRKLLNAKHSEKSPPSTENKHEAKRRRTERVRREKINSTVNKDLENRKRSRSNSHSDHIRRGRGRPKSASAKKHEEEREKQEKEIDIYANLSDEKAFVFSVALAEINRKIINQRLIL

SEQ ID NO: 780178 - protein, 161 aa, Homo sapiens
PGARAGGSGLAAVVCGGGPRRAPGGRAVPVACKSCPCGYIFISRKLLNAKHSEKSPPSTENKHEAKRRRTERVRREKINSTVNKDLENRKRSRSNSHSDHIRRGRGRPKSASAKKHEEERGCRKPMPRTPILEGKLGKEKSAEKKEKREILPGSENNILFS

SEQ ID NO: 780179 - protein, 154 aa, Homo sapiens; identical to SEQ ID NO: 780177

SEQ ID NO: 780180 - protein, 154 aa, Homo sapiens; identical to SEQ ID NO: 780177

SEQ ID NO: 780181 - protein, 154 aa, Homo sapiens; identical to SEQ ID NO: 780177

SEQ ID NO: 780182 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 780183 - protein, 246 aa, Homo sapiens
SEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 780184 - protein, 99 aa, Homo sapiens
RPTQPGPPQPPQQRPYGYDQLIMPKKPAEEGNDSEEVPEASGPQNDGKELCPPGKPTTSEKIHERSGPKRGEHAWTHRLRERKQLVIYEEISDPEEDDE

SEQ ID NO: 780185 - protein, 176 aa, Homo sapiens
RPTQPGPPQPPQQRPYGYDQSPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 780186 - protein, 211 aa, Homo sapiens
SEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 780187 - protein, 127 aa, Homo sapiens
NPLLQNTLMRQKSLYEFGNLYQQRKILMYSLSVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 780188 - protein, 139 aa, Homo sapiens
SEYARSDFLFGFFQNQSQTAPGAMNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKVSVSQI

SEQ ID NO: 780189 - protein, 31 aa, Homo sapiens
MWLSGPWRFKELFLSHRGFIKGKIGVHKHTQ

SEQ ID NO: 780190 - protein, 107 aa, Homo sapiens
MTEAALLHSTGATPCQHISLPSPGQAQVPCLNSKFSRIEGKRGSEFASLTPATCLCPLLVYNATLHSICLLSAHLSKDIRATKDLKDHLIQWFQGFSFPITTSPPAK

SEQ ID NO: 780191 - protein, 109 aa, Homo sapiens
QAHDSLSVINFHLAECVIQLPVNLRELPGAVAHSPLGSELCFSDSGSVPSHTRSFPKAAIRLTANHRRGCTESGWPFSLVFLFERCMWPGTVAHTCNPSTLGGQGGQIT

SEQ ID NO: 780192 - protein, 54 aa, Homo sapiens
VLAPEPEEIWVAEMLCGLKMKLKRRRVSLVLPEHHEAFNRLLGRRTPQRAPPIL

SEQ ID NO: 780193 - protein, 66 aa, Homo sapiens
RPRGRPSWTLQTFPSQRAPMLHVGTGATIRPFPGETEALPSATAWGALGRHTLHFIASCDTGGEQR

SEQ ID NO: 780194 - protein, 51 aa, Homo sapiens
EAKHNTKGPTEEMAPKTRGCRTNYKKILLPTAFLEKLFRGGSRRQSPETKE

SEQ ID NO: 780195 - protein, 81 aa, Homo sapiens
MWGITCDNVRHKSFKFGYNLIYSFFLFWRMLWVSYPRNSNHGQIQYHEAFWSYNFSKCLIISLGLKSIESFRYYLIKMMSV

SEQ ID NO: 780196 - protein, 83 aa, Homo sapiens
QVGVHVAQIVAEEQVEAFLGGWEYWAGMCRLHSQTVGAVGPRHHQSSFRKRRWVMESLGLGREIGEEATVSSKAATVSTPTGI

SEQ ID NO: 780197 - protein, 52 aa, Homo sapiens
GFGHSSVTELLHSLFDLVLVGFDIHNGHKLCCCLLSSSWLTQWLGEPDDELL

SEQ ID NO: 780198 - protein, 80 aa, Homo sapiens
IRGGSNDVLANSPSNAIIPHPEQLLSGNVSGKASQAAGSEKVGQAAGLSITGWSPNRVHSDLHTSPCTSSSLLWAGPVAY

SEQ ID NO: 780199 - protein, 91 aa, Homo sapiens
SGIAGTGCRECLVTNLEGAFLQFAQGPSGRELKGPPGVPVGSVEFPSGRGGRSPLCLGPPAPSAQPWICVCLPVGAWAPWREGQAWTFLET

SEQ ID NO: 780200 - protein, 152 aa, Homo sapiens
KGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGVRPGLGSREGAERGSWLLGGACLSTDQWGAAFPSASFKTFIES

SEQ ID NO: 780201 - protein, 238 aa, Homo sapiens
KGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 780202 - protein, 78 aa, Homo sapiens
GTQLHQPATAFGKPRRRGSTLRFEGSRIIDQGIEVLRFASRSGMMVRCSGSRARPGSQFCLALSSCMTYLTQPRCSHL

SEQ ID NO: 780203 - protein, 121 aa, Homo sapiens
MGHLDWVLNGGPCGERAQKQVHAAITRPPLCPASAQDPQQPGEAPHASSGSPTGKVFPGVLTNHSSSPQNHAGTRHSASVHQEGLLCKSTSSHKQLSRPPGGWLILLWKHSSTHTCTQLCV

SEQ ID NO: 780204 - protein, 36 aa, Homo sapiens
MAAPQKRGREARAELPAACWMHRVEAPPAVIHSLKQ

SEQ ID NO: 780205 - protein, 132 aa, Homo sapiens
KSTYASCLYPSQSPSEAPQYPQEKSQGRWCGSPGPVKLLPPSPSHLPSKSQGLCTGSSSFPECSLLFPPLLSPESCPLILPVSAQTSLLETLFPEPLHELRCPPCPFSLLVSCTFAPEHLKPFVIILLTCVF

SEQ ID NO: 780206 - protein, 92 aa, Homo sapiens
EEDSAEETGLRSLGWGGYPGLSRGASVITGVPTRDRGRWESLSLRRRCAEAESRLAIPGFKMEEGATSQGMQAALENGQGYSFSSGGSRRSQ

SEQ ID NO: 780207 - protein, 115 aa, Homo sapiens
MDRHVDRHVDVAVDRHVDRPVDVAVDRDVDSAMDRSVDHAVVDRDVDDAAVSRGVDTAMDWGVDTAMDTGVDNAAQARVVDDVPMDRGVDTAVDRGVADAAADRGWMLLWIGVWL

SEQ ID NO: 780208 - protein, 71 aa, Homo sapiens
ERQHGTVGTGVFFLVVTFLPSLRALGSSLEEKFSSQNCKPGTKVVLIFKNSARVIMVDTKAGKILVGHNED

SEQ ID NO: 780209 - protein, 96 aa, Homo sapiens
GPGKLRHCWAGAAIALGTEYILVKGDQVTGIVTAKSGDIFRVDVGGSEPVSLSYLAFEGATKRNRPNVQVGDLIYGQFVVANKDMEPEMVCIDSYG

SEQ ID NO: 780210 - protein, 120 aa, Homo sapiens
MTREQDTHRIIRTGQVKKYPTCPDSASVDWFYFLHLFEAHSICTAGPFGKILKSFPSRRNFAGCNSTVNRSCGILKHTTLSIGAEGRRTKVALHIVLHFGLPHWVQQLEGRVTWEGQSTA

SEQ ID NO: 780211 - protein, 70 aa, Homo sapiens
LWVPGALPHSPFPCGSELPLPLRQFQVGGCSASFLSVLHGSRCFCYESQCVLVDDPFEELVFTSHSVSSS

SEQ ID NO: 780212 - protein, 119 aa, Homo sapiens
AQFRECESLLIIMEELFYPGSDWSLPHPVTVVSENDLSQMPITKFIWGLEGGLQRVSPTQSTWLLYMGRSRMTDYSIHENRMVSYLFYISTSTQKYYIHRAYITMCIFPHFIKGDGRFC

SEQ ID NO: 780213 - protein, 135 aa, Homo sapiens
MAWGAPPLAELEGLGSGPRVGPPCLERSCPGFWSQRGRGTARELVSCWKGQLGVGSSRATGCPRHRPLPRVRGPLDWRTSQPWGCPWPVPGSCTLIRFSVGGEVISFPHPSQASWLRPVRNKMLPRCHKEIALKH

SEQ ID NO: 780214 - protein, 117 aa, Homo sapiens
MAVGSLSQQELGSQMLPGAWNCEWPWRWLCCSYTGHPGTRRSSRDPAPATAPAKHLGDTVVGWGGGLKSGEFVSSGSCDKVAQTLVASTAGTDSPGSPRSKGWLFRGPASRSCTPSS

SEQ ID NO: 780215 - protein, 175 aa, Homo sapiens
QKRPHLLPVGPLGRSMRWCLLLIWAQGLRQAPLASGMMTGTIETTGNISAEKGGSIILQCHTYPDGTYTGRIFLEVLESSVAEHGARFQIPLLGAMAATLVVICTAVIVVVALTRKVMAPAAHRSHGHPHVWHPGPFRFSFHPERDPDVIFPSALCAFFLAFVLPISAVIYALPL

SEQ ID NO: 780216 - protein, 194 aa, Homo sapiens
QKRPHLLPVGPLGRSMRWCLLLIWAQGLRQAPLASGMMTGTIETTGNISAEKGGSIILQCHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 780217 - protein, 125 aa, Homo sapiens [sequence omitted]

SEQ ID NO: 780218 - protein, 704 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 780219 - protein, 667 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRTVCRNSWKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 780220 - protein, 595 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 780221 - protein, 370 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLR

SEQ ID NO: 780222 - protein, 63 aa, Homo sapiens
AAQRRDELLNSGASCSTQVRAANSGASFREEPGRQVGPSLPTVSSLRLSLLLRPSHVLCIFCM

SEQ ID NO: 780223 - protein, 118 aa, Homo sapiens
MKPQGDIGRREITTTTLDVVAKTNLCYHGEEHAFWERRAPTYLTVGRISPKLIVRANTISYTEIFKTALKRSNKYNIYKSCLSRVVTTDAGKNTASALKKQFKRITGILSVEKNFITR

SEQ ID NO: 780224 - protein, 87 aa, Homo sapiens
PTGSARRHWRLLRRSSGFRVLMTGPGSGCEAVETHGSAFLIRSFLLLLGKLHVCCPVVFRVCSLGRLCRGSSLCLIGPARVNNLHFS

SEQ ID NO: 780225 - protein, 135 aa, Homo sapiens
LERPFFLSLSVCTLSFFKNKTEICTAFCNVNYTTIKCFKTNSNNQKTSDIGSKNFVLKLEMIASILKFYRTLYLSYRKKYILYILSLFLDICFKIDGRACSFSFRPFVNTSAENSLVCTIPQVQHKLLLNRQTSP

SEQ ID NO: 780226 - protein, 103 aa, Homo sapiens
AGITGACHHAWLIFCIFSRARVSLCWPGLSRTPALVILLLATTTEAPGEYFFLERVQLKKYQGMGSLDAMEKSSSSQKRYFSKGDKVKIAQGVSGSIQDKGSI

SEQ ID NO: 780227 - protein, 75 aa, Homo sapiens
PHSSTVGLESPNHLSSFCEKRKRGSLSYVRRLRQENRYGHGNWFSHGRELFSSRDVISGCRFVSGRETDCREFRS

SEQ ID NO: 780228 - protein, 214 aa, Homo sapiens
MRKLARLKLGLVEMALGMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPAT

SEQ ID NO: 780229 - protein, 271 aa, Homo sapiens
EAYGLAQGAVAEEEGRLHSIQGLYGLAQGAMAEEEGRLHSVQGLLSLQDLQNVNTPLMRKLARLKLGLVEMALGMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPAT

SEQ ID NO: 780230 - protein, 104 aa, Homo sapiens
MSKKGNYAKTDGKSVGWETLPPWLLLPEWPSHSAGLPGTSPERSKGETVPCSSPGMQGGDYIYLIPSYPFPIDQSLLHGGFNSLSLLACITRQLQWLLRVFCPA

SEQ ID NO: 780231 - protein, 149 aa, Homo sapiens
MQDFNTPLLTLDRSMRQKVNKDIQELNSALHQADLIDIYRTLHPKSTEYTFFSAPHHTYSKINHIVGSKALLSKCKRTEIITTCLSDHSAIKLELRIKKLTQNRSTTWKLNNLLLNDYLVHNEMKAEIKMFFETNENKDTTYQNLWDTC

SEQ ID NO: 780232 - protein, 78 aa, Homo sapiens
ESKQCPESKQCSESKQCPESKQCPESKQCPESKQCPESKQCPESKQCPESKQCPESKQCPESKQCPESKQCSESKQCQ

SEQ ID NO: 780233 - protein, 141 aa, Homo sapiens
IESSRSPWCVMHTLTYTHSCTLITHSHMFIHNILMYTYTHTYTHSYTHTALNTLHTHSCTLTLITLHTQDTHAHKKHVHSHILTTQSYTTHTFTTHNTRTLTIHMQHRYTTDNTCTHSTLAHIYTLTTHLHAHIYTLAHIH

SEQ ID NO: 780234 - protein, 165 aa, Homo sapiens
MSVTLHTDVGDIKIEVFCERTPKTCEMESRCVPQAGVQWRDLGSLQPPPPGFKQVFCLSLPRTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 780235 - protein, 161 aa, Homo sapiens
MSVTLHTDVGDIKIEVFCERTPKTCENFLALCASNYYNGCIFHRNIKGFMVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 780236 - protein, 161 aa, Homo sapiens; identical to SEQ ID NO: 780235

SEQ ID NO: 780237 - protein, 165 aa, Homo sapiens; identical to SEQ ID NO: 780234

SEQ ID NO: 780238 - protein, 161 aa, Homo sapiens; identical to SEQ ID NO: 780235

SEQ ID NO: 780239 - protein, 157 aa, Homo sapiens
MSVTLHTDVGDIKIEVFCERTPKTCEAGVQWRDLGSLQPPPPGFKQVFCLSLPRTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 780240 - protein, 112 aa, Homo sapiens
MVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 780241 - protein, 112 aa, Homo sapiens; identical to SEQ ID NO: 780240

SEQ ID NO: 780242 - protein, 165 aa, Homo sapiens; identical to SEQ ID NO: 780234

SEQ ID NO: 780243 - protein, 131 aa, Homo sapiens
KPHGALPGSNQACFVFLALLCIYRASLPSSVAESPQPVRKLLEDRAAVHRHGFLLQLEPTVNRQAGHRALCVPAACSGHLLPTLSAGSLDWRLEGTQGAIPEVLPGACCWPQWNSSDSKPSPQGSGAKPSL

SEQ ID NO: 780244 - protein, 45 aa, Homo sapiens
ICKEATAIIMVNGERLKAFPLKLGTRQEYVLSSLLFNSVLQVQLD

SEQ ID NO: 780245 - protein, 165 aa, Homo sapiens
LTAGFCGEQYYCVCRQWPWDPQARPVHGAGLHSHPPSCGERLARPGQARQKVSAKWPRPHPAISQLLFITFVPHLGVCFLHLDTLPGRSSEPNPRLCSVGEGMTSPPPDLPRVLVSLSAGGPLCVFVQFCCMGFVTQKLMLRKANPTTDLKPPLEPPAGLRPQSL

SEQ ID NO: 780246 - protein, 64 aa, Homo sapiens
SCLELCGEPTPSPGQRFPKAAPVTLHPAPGWDLLRWGRPWEETSLGGRAQALSSGFGVTGWDTA

SEQ ID NO: 780247 - protein, 31 aa, Homo sapiens
MAPTAAGHNHQKIKIPRLIPFYKSRRHPKRN

SEQ ID NO: 780248 - protein, 82 aa, Homo sapiens
YFPSLWEKEERGLAACRQVAPQGTDRVGDRWDMQAFTWLAVSAKVQAAPSMETSLMEVSFPTHLHTHISQKQTFTLLFSILF

SEQ ID NO: 780249 - protein, 39 aa, Homo sapiens
MPSGTGQPPAASTLHAPAGPASLSALCYRWQIPCSPERP

SEQ ID NO: 780250 - protein, 64 aa, Homo sapiens
TVFYSFSNSNLLVDSIQAWRHLMAPHCSYSLVDQKVPVERSLTVTARSSESLEFTFLSRLLVDK

SEQ ID NO: 780251 - protein, 101 aa, Homo sapiens
MVRRVQPDRKQLPLVLLRLLCLLPTGLPVRSVDFNRGTDNITVRQGDTAILRCVVEDKNSKRGLVEPFWHHFAGHDKWSLDPRVELEKRHSLALQAPASRH

SEQ ID NO: 780252 - protein, 107 aa, Homo sapiens
GREALGCCCFCCCCCCVAVSVHSLAGLVPAPSPARPPAWESGLQSEGAQLRHWQRSIQSQRDQTRTLSFGFLFSSSRGLAICTLSFEIVLLLLFTLLLGFYEGFVKS

SEQ ID NO: 780253 - protein, 90 aa, Homo sapiens
QRDNEFLSYISEHLPNARDNAGCCAVNDKEDTVLPLKSDGGRHVNRSSLSIGSNCDCLPARMLLENRGEELASAWRNRSREHWRLQVKNE

SEQ ID NO: 780254 - protein, 30 aa, Homo sapiens
MTHGVLEENSRTPIQVYFYAILLQLCVFSL

SEQ ID NO: 780255 - protein, 83 aa, Homo sapiens
MALGIIFCSQAPQAVTYDSCMTLLLLIIYTSNSPSAVVFRLLFCLFCFVCPYSYYYWLSALNPSPVSESPDSLSFFALPLKKG

SEQ ID NO: 780256 - protein, 50 aa, Homo sapiens
MASGMMHKPILCTSAGRQGLGIGSMQKEEEEFCSHSGAAALISESLMGIR

SEQ ID NO: 780257 - protein, 107 aa, Homo sapiens
TGALNPGWLIFVFLVEMGFHHVGQAGLELLTLSNQPASASQSVGITGVSHRTRPCKTPFRLKAASEDFCTSPPHCTFLLNINKLSGSGSLHSLYCALTWSSLCLPSS

SEQ ID NO: 780258 - protein, 136 aa, Homo sapiens
ATTLCSLFPLAHATLANTGLWLVLEHSRSSPSEGHCTCCARVWNILYMAFHVASTFSSFCSWFQCCLSRGSFPDLLSKAAPSPLLAPIAVLLWFSAWYSYFVYASPYLFISTFKNVSHRRAPMSSLYSLTSSPAES

SEQ ID NO: 780259 - protein, 110 aa, Homo sapiens
LNKDNTASLNMKELTLKDVECKFSKMKTTYEEVTTKLEEYKEAFAAALNANNSMSKKLTKSNKKIAMISTKLLMEKEWVKYFLSTLPTRRGQESPCVENLTSIVLNSKYI

SEQ ID NO: 780260 - protein, 60 aa, Homo sapiens
HHHQPKTFKSFLTLAPKLSIHSTLVLSVLLLKRMYPESNHFSPILLLLSSASLQEEKQGL

SEQ ID NO: 780261 - protein, 135 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERNELILYTSLRNLLFLPSKESWASHQHSVQSETCGHQATLR

SEQ ID NO: 780262 - protein, 555 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780263 - protein, 528 aa, Homo sapiens
RLGSEAGGGLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780264 - protein, 466 aa, Homo sapiens
MDAFRSTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780265 - protein, 487 aa, Homo sapiens
ASRGGWRRESTVKSPSAAAGRRMGSGSSSYRPKAIYLDIDGRIQKHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780266 - protein, 323 aa, Homo sapiens [sequence omitted]

SEQ ID NO: 780267 - protein, 523 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLQKKTDSLTSGATEKSRERSRDVKNSEGDCA

SEQ ID NO: 780268 - protein, 454 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQRCEKQ

SEQ ID NO: 780269 - protein, 457 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQNAPNGYRA

SEQ ID NO: 780270 - protein, 270 aa, Homo sapiens
LCGVLEDPIGAEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780271 - protein, 137 aa, Homo sapiens
VNWRILSFSENSDLVMGHFCLYCHCLLHSLQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780272 - protein, 103 aa, Homo sapiens
MPVPLAALSFPASWPEAVVCQRQKRFGCRLHSQYSLPITLGLVMMGGGGLTSQRSQCIFDFITVTILSCSFGGYSRHQLNRAKEREATCIRQVLKWVQAAARV

SEQ ID NO: 780273 - protein, 103 aa, Homo sapiens; identical to SEQ ID NO: 780272

SEQ ID NO: 780274 - protein, 195 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCCKYSFLMLRRSG

SEQ ID NO: 780275 - protein, 78 aa, Homo sapiens
ARSHTVIFSQHCNTTDFIAMFCIATGSPWNTTISLLTTDDAMVSIDPTMPANSERTPYKVRPVAIKQLSDIHFSSTIC

SEQ ID NO: 780276 - protein, 555 aa, Homo sapiens; identical to SEQ ID NO: 780262

SEQ ID NO: 780277 - protein, 615 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780278 - protein, 386 aa, Homo sapiens
MREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780279 - protein, 305 aa, Homo sapiens
LCGVLEDPIGAFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 780280 - protein, 589 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELHKDPAQLGQPVQNCSHAPRFPQAQSPSLFFTSLLPSLDFLVAPDVKLSVFFLVDAAANLVVVGG

SEQ ID NO: 780281 - protein, 463 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQVRVLQSNQASSHSY

SEQ ID NO: 780282 - protein, 455 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLVSGLFCLGGQPGGGLAKQVIHPAHTGSQEAEIISLLGTRCL

SEQ ID NO: 780283 - protein, 106 aa, Homo sapiens
SAGRCCRPGIHPSNSPLPISQSDREKSEGLPVAPFMDRDKVTKLFPMVEEIMLQPLWESRDRYEELKRIDDAMKELQKKTDSLTSGATEKSRERSRDVKNSEGDCA

SEQ ID NO: 780284 - protein, 246 aa, Homo sapiens
ASRGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSSKTKKTNCPCKYIFWETTKKCLLNGCSISPKALFFKKTWKPWGTHFCIWVWGPPRKNCVLEPINPNP

SEQ ID NO: 780285 - protein, 35 aa, Homo sapiens
VVEIEKCKSDIKKMREELAARSSRGRVCAGATGGR

SEQ ID NO: 780286 - protein, 56 aa, Homo sapiens
SGRGTVSGSSPPIRCKQAQIREVAIGPGDAVRARCSGSGGEVDTRDKRAERGVADS

SEQ ID NO: 780287 - protein, 860 aa, Homo sapiens
RESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTEAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 780288 - protein, 410 aa, Homo sapiens
MVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTEAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 780289 - protein, 120 aa, Homo sapiens
MLSLWGFTLAPAFPNPCSSVLTLVWGTSPGAAHPIHELSQWLMITHTGCPTSGLGPGFQAQQVGKKGGRVQGRTAQEHCPLLAVAMETESSGPVTDSRSPPWEPGGGLESPYSHPGQGAG

SEQ ID NO: 780290 - protein, 166 aa, Homo sapiens
LRIYNYLIFDKPEKNKQWGKDSLFNKWCWENWLAICRKLKLDPFLTPYTKINSRWIKDLNVRPKTIKTLEENLGNTIQDIGMGKDFMSKTPKAMATKAKIDKWDLIKLKSFCTAKETTIRVNRQPTKWEKIFATYSSDKGLISRIYNELKFTRKKQTTPSKSGQRT

SEQ ID NO: 780291 - protein, 101 aa, Homo sapiens
MSLAYSRCPINICRTKEQSEESRQRGAPPMPGPHSGRLLPCPGHTADGRQAEHLQPLLCCPPLAPSSLPHRNMEAQRFKDLPKGTRPGRGRAGSGTQVFRL

SEQ ID NO: 780292 - protein, 141 aa, Homo sapiens
SLGISRELTSRAVGGGQELTWLSGRQPHILLPPCAECNHFCPFRKVLHTRGIEPTVRWIPGPLDAWDGEMLEKVLAVCSDLGTLQSAFLSPSRNALPFNPDTWALGLHLNTLGGEQLTTPLKTASPPCSMFLVTCYLMTAS

SEQ ID NO: 780293 - protein, 83 aa, Homo sapiens
VVVWLYGGSGDGCNGLVMMEAILEVVQLNDFGNYNNESSNIGTHEEEEILEAEALAPVAMEAYTLQNHETKVAIGSSSSCSEL

SEQ ID NO: 780294 - protein, 78 aa, Homo sapiens
AVLRVVNTGVGDVVVWMLPVGRGVLSVVLVVDEIVVWKVVSVADTEEGVTVTMGVSLAVVVEGEDVMADVPFSVVVIE

SEQ ID NO: 780295 - protein, 105 aa, Homo sapiens
MCSSLKCSQGVVGRENILPSGEGPHSGSTWAVRRVSSPLVSLLFWSMCSGQKALRKGGERALAAPVPSNRSPTCMGPEHQKACCSLRNAWNTHLAHLCHKMHNFV

SEQ ID NO: 780296 - protein, 247 aa, Homo sapiens
MDAFTRFTNQTQGRDRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 780297 - protein, 190 aa, Homo sapiens
MDAFTRFTNQTQGRDRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPCSGERTNGPSSLFSILTLSCLTKLVI

SEQ ID NO: 780298 - protein, 247 aa, Homo sapiens; identical to SEQ ID NO: 780296

SEQ ID NO: 780299 - protein, 204 aa, Homo sapiens
TNEITVHYVWVLLAGFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 780300 - protein, 204 aa, Homo sapiens; identical to SEQ ID NO: 780299

SEQ ID NO: 780301 - protein, 253 aa, Homo sapiens
CLEDFNFDGRIHPLLSQTQGGRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 780302 - protein, 112 aa, Homo sapiens
MRCGGRNPSCRIRQTWVQILSCYPGARWSQASCSFSLASVYSSGKCSYEVSYQVQNILPSEIAIRNRIWKLPAQSLVHSRLLKTRGNITVSGRSTRVEYPVTFLSWLMALHA

SEQ ID NO: 780303 - protein, 102 aa, Homo sapiens
AGITGVRHHTQQIFVVLVATGFHLDGQAGLELLASGDLPASALQSAGITGVSHQPDIKFYMDYLIHSLDSSWEVHEVVSPFTEGETEAQGRRGDFNPGRQPS

SEQ ID NO: 780304 - protein, 104 aa, Homo sapiens
SGDLPALASQSAGITGVSHRAWPLEFFVDLFPLMEAPLPSGPFITASLCSHGFQTLLLSFGKSALASLFPNPSFSTWSSTKGPGASPHSSLSSPHPELFRSLTP

SEQ ID NO: 780305 - protein, 108 aa, Homo sapiens
PGSHTLATSTSLFSKHSTERRFLSTKQSIFSSLENSHTGFSTWPKCYLLQEAFSDCLSHPSLPGSELLPSVVFSRRRQKEKEVFQDCGVKWRERGRGEGRQGGAEGWE

SEQ ID NO: 780306 - protein, 107 aa, Homo sapiens
PGGNGASSDTPRPEVHPVTKPTLPQGRGHRSVRPGPSLGGGFLMGHLRQMPQSSRCLGFQGGPNLRWPGLDSSTCEESGLVCHVETTLSTPLPASPTLPSPPMSIQS

SEQ ID NO: 780307 - protein, 72 aa, Homo sapiens
QLNNYLFKAKGLRTWRGLVVQFPELRGQKIWSSDVQRQKEKGVPASIEREVSSALPFYSIWALSQLDDACTQ

SEQ ID NO: 780308 - protein, 114 aa, Homo sapiens
PAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKVIIFY

SEQ ID NO: 780309 - protein, 260 aa, Homo sapiens
GPGGASGALAPCQFGCSDLLRPPRRRAQRRAGGLARALPRPACVPRPAPPPPSRSPPRAPGSAGPMPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGRSCQISCRGSGHPPCHVETQRPNPNWGHLCTLTSGHLSHPQQELGWPLSSNGHNSSDSHVRPPLGAPQWVCVCV

SEQ ID NO: 780310 - protein, 487 aa, Homo sapiens
GPGGASGALAPCQFGCSDLLRPPRRRAQRRAGGLARALPRPACVPRPAPPPPSRSPPRAPGSAGPMPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 780311 - protein, 473 aa, Homo sapiens
GPGGASGALAPCQFGCSDLLRPPRRRAQRRAGGLARALPRPACVPRPAPPPPSRSPPRAPGSAGPMPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWKRPGPGGGACEPRGGEPSSGPVRRELKQFLGWLKKHAYCSNLSFRLYDQWRAWMQKSHKTRNQDEGILPSGRRGTARGPAR

SEQ ID NO: 780312 - protein, 206 aa, Homo sapiens
GAGRGQRRISALSIRLLRLAPASASPRPATCGRPGPRPPAPGLRPAPCATAAEPQPAARPRQRRPHARRPPGPRRPIRAAAAAVAAPAAAALRPRGAASRIRSPHSCDQSPGSHASHRLLPAGHLLSARRPTRSHRRGPLLDPQRAPRRELKQFLGWLKKHAYCSNLSFRLYDQWRAWMQKSHKTRNQDEGILPSGRRGTARGPAR

SEQ ID NO: 780313 - protein, 93 aa, Homo sapiens
AFPSVGHEARVDPGLCPRCPHNRWGCGVNETGCSSSWEPGNGTFCHIVFALGLKGFQMSGPSRAIYGSPDATRVLRRGSGLEPMEAEPGATWS

SEQ ID NO: 780314 - protein, 33 aa, Homo sapiens
SVQWGDFRDDDTKHCFTDSLQHCEAAPANVCTL

SEQ ID NO: 780315 - protein, 65 aa, Homo sapiens
MAGCRLRQFRPLVHPSWARDLDDLESGSDWLLMTSSEMRAKMTGPHSIGLGAHSWVCRHPPVCLC

SEQ ID NO: 780316 - protein, 107 aa, Homo sapiens
MSQGDECYEEKSHLLKKSQKKKKKQKHTWVGRGPGPCGKKALPEATIPVGRGRAPQGEGSGDQGAKQRAAQREELRGQRTLGRGLSLHQFKKTPGGATRSGFVKNPE

SEQ ID NO: 780317 - protein, 179 aa, Homo sapiens
RERSLDGLSGFCLCWGLSTLHLSLAASGGCIHHAGQASFLIPCLLASRSPESTYSGFKIQSPQRDCLITDFVNVKSKAILEMNPFQSKSWKLCLVVILGMSLDQFSCNFLLMKTHAGESLWHVCLCHSFISVFWVRPRRTRMGSLCHRGFGGDGSCGKRVSCQPQNKRGKKRAQHRPKA

SEQ ID NO: 780318 - protein, 80 aa, Homo sapiens
DLYGEDDNAKSRKRCQDTRALCAGTVGILWCRFVAGLTVYWQEQIKIAKVSLFNGRGKTSVCSKHKVVFCALMKIDNNRS

SEQ ID NO: 780319 - protein, 129 aa, Homo sapiens
VARTVGTHHHAQLIFCIFSIVEVSPCWPGWSPSLELVIRLPRPSTVLGLQASATTPGPICIHFYVKHMHQFFCMKTFGHYCGTTEDQVSTIFFFHMYTDFYFVLDIVLHTIDIQYLLKLMKEKRNMKTV

SEQ ID NO: 780320 - protein, 97 aa, Homo sapiens
MCYSPKTPVLDVAKTKDAQTLTPGATEHPWPSGSEKTQHQDVPKLPASRSAVMSPRGQDTAHGGGTAKSCCFSPVNTELLHSPLLVSVPATQLVDRD

SEQ ID NO: 780321 - protein, 94 aa, Homo sapiens
DSLGTSPVSRGFLPGLRKGPDQMENSVTCSSSGVYFPGSSIRGNKARGTLRRPSVLEAGRQTLGILSPAVFLGPHWMTLSKLLPRLTFSSVEWR

SEQ ID NO: 780322 - protein, 109 aa, Homo sapiens
MTLVPPVLAPGPCSYCSTPSLGAPLLPRALGLCSRGLGTCMSLVRRPHKRAWPTSRSLPDSHFEIKIINTHTYRGRRVRGELSGVEAKAQGFTKHRAAVTWQPTKGVSE

SEQ ID NO: 780323 - protein, 739 aa, Homo sapiens
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKLWTIRNYLLHKLLKLFRIYNSGDF

SEQ ID NO: 780324 - protein, 216 aa, Homo sapiens
RSTVADSGPTVVGLLCALPVGRACALCWSPWRGLGAKTRLSRLVLNFLPSAPADFPCRLVGLSAAAGLGESEVWQRCLRRPTGRYLPTPLSSSCLLLLPSPPDPPELRATAGLRLQPQPVTGGAFRAKLGGLFGVPHGTASDPRPGTGLAGPRGAGWRRRRLGVFRRVAEPKDAPSPRRRSRTPWAERPMCGPSRRPAPCFLGFFFRFLSPFIPYV

SEQ ID NO: 780325 - protein, 207 aa, Homo sapiens
MIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGTFLKNYFKRFSSSHSPLSKCDFPKVITFLFW

SEQ ID NO: 780326 - protein, 739 aa, Homo sapiens; identical to SEQ ID NO: 780323

SEQ ID NO: 780327 - protein, 709 aa, Homo sapiens
MDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKLWTIRNYLLHKLLKLFRIYNSGDF

SEQ ID NO: 780328 - protein, 739 aa, Homo sapiens; identical to SEQ ID NO: 780323

SEQ ID NO: 780329 - protein, 128 aa, Homo sapiens [sequence omitted]

SEQ ID NO: 780330 - protein, 139 aa, Homo sapiens
GKDGKACSVLGVGRGRGVDGPYRAAKDKELLFETAFLLPNLPPTQQVLHILYWEEGHTRLHHCPPSLSLPCPASRSTPSWGSFCDSPYNSLGWSGVCEQMQKAVLGRSADMPLACGWEVAEAKVLPRSGVARSSTGSVR

SEQ ID NO: 780331 - protein, 126 aa, Homo sapiens
KVRGRCYVCLRQGLVQSPSWSAGHNHSVLQPPPCRLNPSSHLSFPSSCIYGMHHACLIFGFLVEKSSRYVAQAGLELLASKRLVLLWPKYWDYRHETSYLAFFSFLFFFPQCYLFTFHILPLHIPQ

SEQ ID NO: 780332 - protein, 155 aa, Homo sapiens
LLSSSNPLGENAGGSGCCLVAAVSDQVPASASGHPLSRIQHHSLNSNFPPTRGLLCGLQPARMLSAAPVPYPLHSHTLPGHGYTVTHTPHSHTVTQSHVATQSHAVTQSHAVTQSHTVTQSHTVTQSHAVTQSHAATQSHAATRHTRSHSHTWPH

SEQ ID NO: 780333 - protein, 103 aa, Homo sapiens
ENIFMYGGRIETNDGNVTDELWVFNIHSQSWSTKTPTVLGHGQQYAVEGHSAHIMELDSRDVVMIIIFGYSAIYGYTSSIQEYHICELLKNCNFFIDWECFSL

SEQ ID NO: 780334 - protein, 117 aa, Homo sapiens
MTDFDRFKVMKAKKMRNRIIKNEVKKLQKAALLKASPKKAPGTKGTAAAAAAAAAAAAAAAKVPAKKITAASKKAPAQKVPAQKATGQKAAPAPKAQKGQKAPAQKAPAPKASGKKA

SEQ ID NO: 780335 - protein, 68 aa, Homo sapiens
QLSGCGGWPAALRNAALPLSQPTASLAQKHSAPPWLAALSPGLMDRTPTRAFAGPCCPGPALLCNREE

SEQ ID NO: 780336 - protein, 63 aa, Homo sapiens
MAFQLYFAKSSLYVVRVVLLTRQFRFTRLKLAYKEAKKAGQRSHNQHKVLSVAVSVVQSPCFN

SEQ ID NO: 780337 - protein, 119 aa, Homo sapiens
MYTAASWYPERCLAQGFPTPRPRISTSHGLLGTRSTAGGEPRASWHYCLSSASCQISSVALDSPRSLNPTVNCAWEGSRLHTPYDNLMPDDLRWNSFMLKPSCPISGKIVFHETGPWCQ

SEQ ID NO: 780338 - protein, 106 aa, Homo sapiens
HVSMQLAFPSFFSIGLSSPFHLEIFFASFKFQLCVNYLVKSPLISSPSSPAHTHYVELIIPFHILLICLVNASILICITPNHNYYKLLEGQDCALFIFTFPLSGPS

SEQ ID NO: 780339 - protein, 158 aa, Homo sapiens
PSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLP

SEQ ID NO: 780340 - protein, 136 aa, Homo sapiens
CIFQQQLTGIPLGKLPPSKCSFILYLQNPVTHINKQMGAFQLRITDKPSIIIDKLKNISSHYCLRRHLLCISLNPWLCSPCSSDSLPSTSSCLLISSPIVSEIGGFLVSLTSRMKPRTLVVSVTVLKGGVSRVCSF

SEQ ID NO: 780341 - protein, 58 aa, Homo sapiens
MDGNLLQWVPKYAGVSPRDRCKLFCRARGRSEFKVFEAKVRITLGLRSRDGEEGRLSP

SEQ ID NO: 780342 - protein, 890 aa, Homo sapiens [sequence omitted]

SEQ ID NO: 780343 - protein, 642 aa, Homo sapiens
MFPAPAAPRWLPFLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMALIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 780344 - protein, 342 aa, Homo sapiens
SGVRCVSRRARAPPWRLRRRVLLRRPVAPSRKLGSARAPAPALQIRKGTSSGLPGRGGGSGPGNNLSSVAGNWRGSSFAVERPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 780345 - protein, 342 aa, Homo sapiens; identical to SEQ ID NO: 780344

SEQ ID NO: 780346 - protein, 277 aa, Homo sapiens
SGVRCVSRRARAPPWRLRRRVLLRRPVAPSRKLGSARAPAPALQIRKGTSSGLPGRGGGSGPGNNLSSVAGNWRGSSFAVERPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSVSNAKACSKLEEDTFLLFCKVRFT

SEQ ID NO: 780347 - protein, 94 aa, Homo sapiens
AEFAACRGEHALRPGGCGDGSSSAVRSRPRGSSAVRVRPHPHSKLERGRLVGCPGGVAGAVLEIICPLSPGTGEVVPSRWRDLEWPNIKVKFKV

SEQ ID NO: 780348 - protein, 418 aa, Homo sapiens
AEFAACRGEHALRPGGCGDGSSSAVRSRPRGSSAVRVRPHPHSKLERGRLVGCPGGVAGAVLEIICPLSPGTGEVVPSRWRGTSGARRHAHPIGARGAADGGVWPSWGSSGRRGSAGRRESPPPSPRAPPSSGSPRIAPRLSGVAGDGGGADAESGSRPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 780349 - protein, 166 aa, Homo sapiens
NWRGSSFAVERYVRRAAATPTLSGPAEPRTAGSGLLGVALAAEALRGGGSRRLLPPGPLPRLEAPESPRGCPESPATVEGPTRRAALGGFGGGEDTAAPSRVARSVTLRTLLNAGGVCARSPIRKDTGRPRACVSQRSELPSLNGEADRSGASTSLEARICLLGCR

SEQ ID NO: 780350 - protein, 200 aa, Homo sapiens
SGVRCVSRRARAPPWRLRRRVLLRRPVAPSRKLGSARAPAPALQIRKGTSSGLPGRGGGSGPGNNLSSVAGNWRGSSFAVERPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGNLTPNSIW

SEQ ID NO: 780351 - protein, 284 aa, Homo sapiens
SGVRCVSRRARAPPWRLRRRVLLRRPVAPSRKLGSARAPAPALQIRKGTSSGLPGRGGGSGPGNNLSSVAGNWRGSSFAVERPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTGSSEKSSRASEQTHQEAVACLDTQNSPACTVGCRSGPQHIPHDRMLPSASPRLCFTLLDCVSILWFSG

SEQ ID NO: 780352 - protein, 418 aa, Homo sapiens; identical to SEQ ID NO: 780348

SEQ ID NO: 780353 - protein, 41 aa, Homo sapiens
VPLCSDHFSENPGCPSKGTEKQGASQSARSLCGFLSLHPEA

SEQ ID NO: 780354 - protein, 113 aa, Homo sapiens
ARLGLLKCWDYRHEPPCPAETAFLKAPGEVAAVMLRVPGLHICCRALPFPTPAAFLTFPPLSLSLCTDCLLPSGLRTQFFLSGMSCYSPLPYTPHLLFPQQHPVLKPSQDLPG

SEQ ID NO: 780355 - protein, 109 aa, Homo sapiens
VILFLYLESKLPAVQCAVGAGQESTSGSHHFLSHIISVSGKQASSSPVCCWSRTRIHIGKPPLPESYYFCIWKASFQQSSVLLEGSTFIKRKEVLGHETHLPCLLCEGR

SEQ ID NO: 780356 - protein, 168 aa, Homo sapiens
RQRLFKRWDGGYGLHMQNPPGLREEPRAPWAQQEGTHSTAQGLYMRGKELTAKSQPGCDCALPSSLNSTYPISLNSTYPISLMLPPPTVTAPTGPRGPALRFRSEPHVHTDRPERCLRCHLHLDALKWEEAVQGPPDRDLCGCYSVSSVLPGCAEPWNHGKTFTCTAA

SEQ ID NO: 780357 - protein, 35 aa, Homo sapiens
MGLSQDSGWLGLLVLCLSPLPSYYSYQYDAVRSGL

SEQ ID NO: 780358 - protein, 176 aa, Homo sapiens
MDQVFHTRDQAKTRLPLPLLGPHCPQKAAAVIMGNIFGNLLKSLIGKKEMRILMVGLDAAGKTTILYKLKLGEIVTTIPTIGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 780359 - protein, 181 aa, Homo sapiens
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 780360 - protein, 56 aa, Homo sapiens
SLVNWASLRSEGKLTSFHWVSILGHSRCQAVGPELGRWVWLRCSLPSAADLGRPPC

SEQ ID NO: 780361 - protein, 47 aa, Homo sapiens
MGTQVAGNRVIAREHRSKVWNLPRSTEQAFLPSAHGFVYQLCARLRL

SEQ ID NO: 780362 - protein, 116 aa, Homo sapiens
LNRLIQRIRSEIGNVKKQCADLETAIADAEQRGDCALKDARAKLDELEGALHQAKEELARMLREYQELVSLKLALDMEIATYRKLLESEECRMSGEYPNFVSISVISSTNAGAGGA

SEQ ID NO: 780363 - protein, 213 aa, Homo sapiens
EGGRTAQPTAVLRKFLEPRLISTEENTQAAETMGPLSAPPCTQHIKWKGVLLTASLLNFWNPPTIAQVTTEAQPPKVSEGKDVLLLVHNLPQNLTGYMWYKGQIRDLYHYITSYVVDGQRITYGPAYSGRETVYSNASLLIQNVTREDGVSYTLHIIQRGDGTRGVTGNFTFTLYPKLPKPYITINNSKPRENKDVLPFTCDPKSENYTYTWW

SEQ ID NO: 780364 - protein, 117 aa, Homo sapiens
SVSGLLPPIRQYPMPWDSGGSGIPAFHLFFHLFVLFTLCTKKRGLYYHRLLFLNRNSGWAQWNTPVIPALWEAEAGGSPEVSSSRPAWPTWPNPVSTKNRKISWAWWCASVIPATRE

SEQ ID NO: 780365 - protein, 130 aa, Homo sapiens
MRTLNTAGWLRNCWRTVKYRENGETELAMGSWHCPIPNARRGPCPAAAASSRRLRRGPAGTGPANRGHSQLRDSPGSTVRQDLGTLPKLEMGILAMAVWTALGGHCRWHSAWLGGSCCCFSSCWSLTGGS

SEQ ID NO: 780366 - protein, 246 aa, Homo sapiens
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 780367 - protein, 246 aa, Homo sapiens; identical to SEQ ID NO: 780366

SEQ ID NO: 780368 - protein, 70 aa, Homo sapiens
SCLSQQLHAPPCCAISTGSPWGVLGDKREGTDFEDQHLHSYPGSTTHQCHSLGTLTQPYFRKERMEPHGN

SEQ ID NO: 780369 - protein, 76 aa, Homo sapiens
MEGHLEITGVGMKVVVFLFVFYSETPNFKYAQLNVSYSGLVNDNWKLGMNKRSLRYIKRCLGALPAACMLGPEGVP

SEQ ID NO: 780370 - protein, 49 aa, Homo sapiens
MRTDNNPLSGPADAPAPPVESSPPPTQTLPGAQCPLGEAASQGGAIPRR

SEQ ID NO: 780371 - protein, 126 aa, Homo sapiens
MRSQQHKYSRMNVSYSIVLTINMMSTKGLRYISPALLTTLEYIRFTLVYIGIDHNMIKLPQYQRRMLLYEIRTSLHAGLSTGQFSRIISTSHCVLPVMFKEYDNFILGPRYHTVFREFTKIELALL

SEQ ID NO: 780372 - protein, 55 aa, Homo sapiens
WPSVLSFALVAPPESRAVAKPGACLLLGHPGMSCLLASARWSGRNPWPWWDRQAS

SEQ ID NO: 780373 - protein, 78 aa, Homo sapiens [sequence omitted]

SEQ ID NO: 780374 - protein, 107 aa, Homo sapiens
MGTLCLLVQGVEEPRHRGWIQQSGAGLRGIPRFLGWVLVSGFLPALVASFYEAPSGSLWVQAILRVWTLWLGTSSGMAFGGGVWPMVRQWRRAQGGPAESPGKLHSF

SEQ ID NO: 780375 - protein, 113 aa, Homo sapiens
AGGQQIGFLLGSCGIALALTSEVCLKGLPKTQNGEIVQFKGWPRLKWVVTDSKYLSKPPKDWQPHISPAGTEPAYIEYKTSKEGSVMGVTVSRLAMLSHCQALSQACNYSEGQ

SEQ ID NO: 780376 - protein, 76 aa, Homo sapiens
PCLTLSKPRNVDRGYAATGLTKAALASPWRAGPGAAGTEWTPTWELLHGKTHAKVDLLDCSVIPLELDGLVAHGLE

SEQ ID NO: 780377 - protein, 112 aa, Homo sapiens
EQSLIFPQVHRAGDLGIGKNCSVPGPRVPCSTKMAAVITGLGNSSAHFEFLEGPLKDRYKQDLTAKAGINTLSFNAQILTNINSINNIEANMTSTNGPSKALSDQPWRDGDV

SEQ ID NO: 780378 - protein, 129 aa, Homo sapiens
ELFRPTWACPGQTRGIPPCQQEGLTFTFKLITKGVRELCGESGAPASMIPVGRFSVLIPSPWMDKLQNPQATASRLGQRGRPGAIQWLAGSLTHLPTNSSCREIGSTCPRWSCFGVMSAGVPVMLTEQQ

SEQ ID NO: 780379 - protein, 112 aa, Homo sapiens
RPDQTRGIGGSGPLSWASKNHSHRVRLCRPRGKAAWLPQTPDTPLLACRLPSPMATLDRDTTRDTLREPDFHMQRGIWGWFGSVSTGGGFSDHPPPTSFSARGVGSLPGGVE

SEQ ID NO: 780380 - protein, 79 aa, Homo sapiens
LLDLLTVSLSIVQARLDSFDNSDIKALLGAMQSAFGVPASHRTHLEKNNGPTLRTLGFTGNYSSPDDAGPDQDFTHQLA

SEQ ID NO: 780381 - protein, 79 aa, Homo sapiens; identical to SEQ ID NO: 780380

SEQ ID NO: 780382 - protein, 455 aa, Homo sapiens
MDETQGPLAMTVHLLANSGHGSLLQRTLDQLLDCICPEVRLFQVSERASPVKYCEKSHSKRYRFPGMSVLLFLHESPGEDRLFRVLDSLQHSPWQCYPTQDTRGRLCPYFFANQEFYSLDSQLPIWGVRQVHCGSEILRVTLYCSFDNYEDAIRLYEMILQREATLQKSNFCFFVLYASKSFALQLSLKQLPPGMSVDPKESSVLQFKVQEIGQLVPLLPNPCMPISSTRWQTQDYDGNKILLQVQLNPELGVKNGILGAGMLPLGSRLTSVSAKRTSEPRSQRNQGKRSQGHSLELPEPSGSPTSDRCAGTSWKSPGRSFQVSSPAMGAHLHLSSHHLESGARMKVLNRENSFQKLEAETNVDTGLTIINSEPRQTYFGGFPRDLQTSQPPFCLPASSLGVATSKNNSVLKERVSPLPLAGQRDLGTRKTISECLLHLQVQGEEKEEDEEEFFI

SEQ ID NO: 780383 - protein, 114 aa, Homo sapiens
NFCHFFLQVKTWFQNQRMKSKRWQKNNWLKNSNGVTQGCLVNPTGNLPMWSNQTWNNSTWSNQTQNIQSWSNHSWNTQTWCTQSWNNQAWNSPFYNCGEESLQSCMQFQPNSPA

SEQ ID NO: 780384 - protein, 68 aa, Homo sapiens
ALPILPFRLTKNFSHDSEKYHSAIRADLLLPNCCQSGEAIALGGAEYENMRCRLGVVANVCNPSTLGG

SEQ ID NO: 780385 - protein, 124 aa, Homo sapiens
AQRDFPSRFSAPGSPVPQVPTDPPVRPILRAPSVAVLRSTVLRLKPCDVLATTLRICRVLKFLRTPHSCPVRKRPWPGSSDARPRLGALSSLARRRGELAREPLVVCRQRCYVVALILHAWSRL

SEQ ID NO: 780386 - protein, 61 aa, Homo sapiens
AAGSGAAGTERTQDPRDIYLELTTVGNDLELSGLAYQEEGKTDGNAGYMVLETELRPPGFM

SEQ ID NO: 780387 - protein, 101 aa, Homo sapiens
CSTLNCHWPGVGTHIVLYQDCCQSRVTEADGQTGSKVWTATFCAEPSLRVVRVDEQGDPGPRLAWLQASQEGEERRPKRRSTCLRPCVGLCPAFCQPRLLS

SEQ ID NO: 780388 - protein, 114 aa, Homo sapiens
GFEAESSLLPSIIGSFTGRWPLMPVGLSGVRGPAWPGGRPSFQFSRTPAASCWGPILPWEFKASNPEPGVLVRSSRGAVSRHWMREGPLRVFPGSGLVLLAGGEAAHPAVSLAP

SEQ ID NO: 780389 - protein, 95 aa, Homo sapiens
MKHSLGTRAVRSILPDHLTVETSLSHPPGQRPNSLTAGTSLPYPAGQQALPPTPLLPSPMITPACERQLVLAVSWFPPLQGFASNKGVAVEAVKS

SEQ ID NO: 780390 - protein, 116 aa, Homo sapiens
FFTYRKKESSDTGPVLHTLVRMKHSLGTRAVRSILPDHLTVETSLSHPPGQRPNSLTAGTSLPYPAGQQALPPTPLLPSPMITPACERQLVLAVSWFPPLQGFASNKGVAVEAVKS

SEQ ID NO: 780391 - protein, 95 aa, Homo sapiens; identical to SEQ ID NO: 780389

SEQ ID NO: 780392 - protein, 39 aa, Homo sapiens
SKVFESSLRILNGTSGPTQGLRDPDTLKEEHRLGWLFHL

SEQ ID NO: 780393 - protein, 52 aa, Homo sapiens
MLKVRSNSRTPRQASSTDNTPKLKLNEQVLISHGFTEASTSEPTHSDSPAWL

SEQ ID NO: 780394 - protein, 99 aa, Homo sapiens
VLACRLSFLPTLSSSSASPQLCQEVGCGCRTDLSGLSVAGKLDQERQVGGQAGEPSVQGGSGEGGGWGQRGRAGEALDGAMRLCREDQDEGASSDSFTN

SEQ ID NO: 780395 - protein, 111 aa, Homo sapiens
MPSLSQPPPTTEQTSSAQEGCLTTATDITHTMPTAQGLKSLPTCLAHCCHSWCLSKPFGGPIIGLPGPTDTSASIHHPETQRQTCSAHCCHHWDLKIGLPDIPLPNRTCLH

SEQ ID NO: 780396 - protein, 107 aa, Homo sapiens
MVNKDSQRRNVQVIFTSLCPCSLGKIWPSVTVIFILSLLESATLSRPTVMALVEMLASSTETDSASCLQVTLPLALVPDLNLFASITSCGFLNLWPFESQSLCSETL

SEQ ID NO: 780397 - protein, 112 aa, Homo sapiens
AHTFHRAQGSFGGQRSGENATGRRKSPASSVTTGIQPEPPGQNSGEGANPVRFAKDLNLRPETINIIEDNIGKTLLDIGLGKDFMTKYPKPRAKDINRKFSKEDTQMANKHM

SEQ ID NO: 780398 - protein, 97 aa, Homo sapiens
RGDSTGSCVWASLFYKHRQVAALLCPLYPESGCADALSYCPGKRPVNAILQMQMITLSCSYSPRGEQAIEGTQSKLLALTKNLMHLGKDAPGTQHGP

SEQ ID NO: 780399 - protein, 75 aa, Homo sapiens
NSQLWAPSYVTLLKPILNSWSQGPGVPGPLAQVTTTHSGRQAAATQTFCPNIFPQSLWLLGRFSGTSVWTTLFML

SEQ ID NO: 780400 - protein, 87 aa, Homo sapiens
FVPRPRPDADRAHGCRAEAGGFSLVPCTASGPVWPLLGLGWGCSRPRDAQAEARDLHEQSGDTPNSSVSRLRDPTVGVGRGSPCQGW

SEQ ID NO: 780401 - protein, 79 aa, Homo sapiens
AAVRMWHHSIGLRPERHQTIPNGGAFCKMTASNFQSSWLRKCFRLKETEDTELNAICDSGLDPPFSRMQLGQPEKSDGV

SEQ ID NO: 780402 - protein, 53 aa, Homo sapiens
MATEGPQVQQLWTDCCKNTPLPWSQPACHSRCHPRGPSTGDLVEGQVTRGRDR

SEQ ID NO: 780403 - protein, 334 aa, Homo sapiens
ERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYERGCSQGPEQRLQQEDFLRVQQLSASRAVRPSYTPSAPMDTNLLSNIQKLFSERIDVFSPVEIQQGVGADRHHQDQPEDAAMHRSVPAPHGTQDLVSVVLPRRQLSG

SEQ ID NO: 780404 - protein, 372 aa, Homo sapiens
ERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVKKRKMKIPPPSTYKKPLHQGVPKAQNNNPNKTSPLQQQPPPPPYPPTQTPSAPMDTNLLSNIQKLFSERIDVFSPVEIQQGVGADRHHQDQPEDPPGVCAPTFGFLQQVQVDCHFLQLYLWRFVADEELVHLLLDEEVASAALRSPNPVPMEPSVVEVICERQA

SEQ ID NO: 780405 - protein, 75 aa, Homo sapiens
AHGWGWARAKHLGSGFFPGPSAGRRGDLGRGWGFLASCDFGRLAPLLVQSGKAQGEPGEVPPPLWAELAISSSSL

SEQ ID NO: 780406 - protein, 114 aa, Homo sapiens
LPRPGVGGCVCAWQVATQACSPAPRCSFLAWIPFSSPSAREVDLNLPLLRNAQVLMSQFILSMWNEMVISWLSPDRCGWPQAGPLTSLSAFISRVWPSPGLAVGLRQDTVRRAF

SEQ ID NO: 780407 - protein, 114 aa, Homo sapiens
LPSPVWAPAAQGAEQKPPASRAGGGSACAPRPAWSGPAGREARRGAGPVTGRGDPAGGGRGTRRAFAPEPGPRPDAERCRSAWPPPASTALQTKPARDPAPGDLKAEALNSPLI

SEQ ID NO: 780408 - protein, 83 aa, Homo sapiens
SGGATGTRPGEQSLLEPGREGHPRLQHAPSALPASLPPEWGPRRPLVPVTQQRRVSLRRVSGDAAARIRTGDLKAEALNSPLI

SEQ ID NO: 780409 - protein, 114 aa, Homo sapiens; identical to SEQ ID NO: 780407

SEQ ID NO: 780410 - protein, 74 aa, Homo sapiens
AGGATGTRPGEQSLLEPGREGHPRLQHAPSALPASLPPEWGPRRPLVPVTQQRRVSLRRVSGDAAARIRTGAVE

SEQ ID NO: 780411 - protein, 102 aa, Homo sapiens
KSGAAVGGVLQALLPRKSCCPEWRGSRMKEGMSNNSTTSISQARKAVEQLKMEACMDRVKVSQAAADLLAYCEAHVREDPLIIPVPASENPFREKKFFCTIL

SEQ ID NO: 780412 - protein, 31 aa, Homo sapiens
MHQPLLAPDVASVPVLGPYSSRQAPHLPYSI

SEQ ID NO: 780413 - protein, 116 aa, Homo sapiens
TGFRLSWAAPRGPHTGCAFLRPPAASKSSGRSASLPASRHLCLALLMVLPKRLFAVGHPVHRGTSCALWGVEPHPWSPPTDDNDTPSYETRNDSTHCQMSPRAKSPTWALCYPLMI

SEQ ID NO: 780414 - protein, 115 aa, Homo sapiens
MSSSELLSKPLTVVYKSLHDLSCYIFHSRSRPDLRGFSLNLLNMLLPEGPFPLPLPGMLFPRHASAWIISMPPQVFALMKPSLTTLFKIVIPSHSGPYLLETECFCPPKIPMLKP

SEQ ID NO: 780415 - protein, 38 aa, Homo sapiens
CDTNRHHSVSSQENKKDWATGKTQLQEITEEMKHAPRV

SEQ ID NO: 780416 - protein, 104 aa, Homo sapiens
PSAPLCLPAFQAPHPDVASPPPSAASATAALSQLAFLALSCHPPTVHHHPCPGSCCSLFCLFSAPWTSLLASTLLTAIQVTVLKTKPTEILLSPKLPKVPISTG

SEQ ID NO: 780417 - protein, 341 aa, Homo sapiens
APPPALPSPPRRVQAGAGRPGVAALGGRAAPERAVGWRGSCARPAMEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFHSLNHLVGYTPRGRLSEAEEGLYLIAKRNRKLKCTFSLTHPANRSRETGSFL

SEQ ID NO: 780418 - protein, 33 aa, Homo sapiens
MCSIVAIVIHKGIAEPPQLSAVILLASIPAVRG

SEQ ID NO: 780419 - protein, 38 aa, Homo sapiens
YDMTQETSQTIEKSEYYYIKYVGLIGHLYTNLDVYLIP

SEQ ID NO: 780420 - protein, 86 aa, Homo sapiens
DRAGTAKQRLGRILKIHRNGKLLLRQVIVQAECRQAIHEPKLKRRDAQSVKEQTIHPILPFPCPSFVDCLHCPDSAPISHLDVFVT

SEQ ID NO: 780421 - protein, 106 aa, Homo sapiens
MAPSSPTPSGSGHPRQLGHTLSSRLHIVLAPAPRTRCPPDPTGQRFKGRSDVSSICASSVNKDVEPGAQVKGLLQAKLLHEERNIINAAPVTVTDSKAYDQNEFLT

SEQ ID NO: 780422 - protein, 364 aa, Homo sapiens
GGKLFVQDEKGAFNFDQETVINPETGEQIQSWYRSGETWDSKFSTIASSYEECRAESVGLYLCLHPQVLEIFGFEGADAEDVIYVNWLNMVRAGLLAPESSTDLKAFNVVTRHHMQARLVTPDESAVRLEREIVIIDFLTTGSDGSPDVPVSASTCSKIRSVGNPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKAPVRPHLAKLEEDVWPCPQFHQTKAASGPPFVCVFRGWGGGGAGAWTLVLPQLRVVTQPLPFVSTFQPANCFPSVISFHLHCRTWSEQ

SEQ ID NO: 780423 - protein, 110 aa, Homo sapiens
HIRTEAGSHPLSVPTLHLGTFPPQSLITSVLSMLYHALGWVPLWPFHLHSLLSGPSFSNADLTRSLSCFKSLRDGCQPRGRREHGLGRWPCLPMVSYHLLAVSSGAMLGS

SEQ ID NO: 780424 - protein, 81 aa, Homo sapiens
STCLCLGRGDFSWQATSRGWNVNLHWASGSSPCLPVGTPGITTAAFMDAQLSPHDSDSGRVGWRRGFYNPQVTDAQPGFTE

SEQ ID NO: 780425 - protein, 59 aa, Homo sapiens
IEQKPTVMWYTDLQGFPLLSASPNNLIWKILPKVLHTPFPLSKPQPKGKRGSGKGMRGG

SEQ ID NO: 780426 - protein, 532 aa, Homo sapiens
MACVTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 780427 - protein, 507 aa, Homo sapiens
MACVTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISRSQTFGYNGRACQEWLPFLSPSAS

SEQ ID NO: 780428 - protein, 712 aa, Homo sapiens
RDSPAWAMEENPTLESEAWGSSRGWLAPREARGGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNALAYSTCLVTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 780429 - protein, 453 aa, Homo sapiens
ETAASVHVKEDLWRARPGEPGGPRLGKWSPSGHLSCLQVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRFQPHGDGWEMMKGGGGQRDVGADRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 780430 - protein, 71 aa, Homo sapiens
PGYHTPHLLTSPLRSGSWSQDHKRPLLECEERKGEAGQGAAWTTGNSETPLAGVPAPAALTALWAGHCVTM

SEQ ID NO: 780431 - protein, 229 aa, Homo sapiens [sequence omitted]

SEQ ID NO: 780432 - protein, 229 aa, Homo sapiens [sequence omitted]

SEQ ID NO: 780433 - protein, 104 aa, Homo sapiens
MADTTPNGPQGAGAVQFMMTNKLDTAMWLSRLFTVYCSALFVLPLLGVQMSCFKKERSSALSILTPVNYIQMEFNQETTYLSSEYLPSLVILFASCCHIYEKGP

SEQ ID NO: 780434 - protein, 229 aa, Homo sapiens [sequence omitted]

SEQ ID NO: 780435 - protein, 221 aa, Homo sapiens
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRLWCPKTVTIVTPKRSP

SEQ ID NO: 780436 - protein, 229 aa, Homo sapiens [sequence omitted]

SEQ ID NO: 780437 - protein, 229 aa, Homo sapiens [sequence omitted]

SEQ ID NO: 780438 - protein, 106 aa, Homo sapiens
KSGINAEGPLRPENILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 780439 - protein, 229 aa, Homo sapiens [sequence omitted]

SEQ ID NO: 780440 - protein, 40 aa, Homo sapiens
FVWFQEHEKNFKKYRRFHTKQTKMDPELPLPCLYNMSTTH

SEQ ID NO: 780441 - protein, 50 aa, Homo sapiens
NSSPLSTNHLTLASNSVNYKFLAPALPGFTGCMPPTSVSLATSPTTPSPA

SEQ ID NO: 780442 - protein, 46 aa, Homo sapiens
CRDDRCEPPRLAHGQILKHGFPATAPWPFELDQFLEQGRPGHCRVL

SEQ ID NO: 780443 - protein, 998 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 780444 - protein, 761 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSEKENS

SEQ ID NO: 780445 - protein, 101 aa, Homo sapiens
MRNKNIVHMLVKALDRDNFELLILVVSFLKKLSIFMENKNDMVEMDIVEKLVRMILVEHEDLLNITLRLLLNLSFDTGLKEYRWYKLDCFPSSLHSGNDNY

SEQ ID NO: 780446 - protein, 97 aa, Homo sapiens
MVIRLSGGLRQRESRGPGRRKVRGAGPSGTQAGDGETEQARRKLYTRQRFAGIIEVRQHSRKNRNQATMKDPEVEEKEGRRTKGAKKNAEKDTTTHR

SEQ ID NO: 780447 - protein, 68 aa, Homo sapiens
VQRSIWSPLEALMFHTENDITTQREGTEKGTRFARGREEAMDGTGLRINFLPDRQKLIKFLIETYKSM

SEQ ID NO: 780448 - protein, 37 aa, Homo sapiens
GPRDPVLGQVPMAECLGAVWFGPQSPVANKRGGGGRS

SEQ ID NO: 780449 - protein, 83 aa, Homo sapiens
WGPSPPGRIQEQAGVAAPRGGRGRPCPPALLVPLALRGGASCHSVTMHHLWPLEFELIKMKYSWPGVVASACNPSTLRSRGGR

SEQ ID NO: 780450 - protein, 91 aa, Homo sapiens
RSRLQDSVSKQQQQQQQQQQQTHTHTHTHNRRKENVLTLRTEGLGSAFRTGYIRVLTQCHQKSLCILTLLSSALASFSGRFFPVGRPPLMN

SEQ ID NO: 780451 - protein, 108 aa, Homo sapiens
MLQGYSNQNSMVLVPKQRYRPMEQNRASEIMLHIYHYLIFDKPDKNKKWGEDSLFNKWCWENWLAICRKLKLDPFLTPYTKINSRWIKDLNVRPKTIKALEENLGNTI

SEQ ID NO: 780452 - protein, 114 aa, Homo sapiens
PLLWAVVQASRLFAELLRLEGTKAFMTSFISDASCANSLRWVNAINPVLQRGEEPQRGQMLPSRSCSMCGAEVISPSLSVGPRDKEGVRCRGLGRPLLMILELGLQETRDGHGG

SEQ ID NO: 780453 - protein, 83 aa, Homo sapiens
MQELWRHGFLSRFQKTSQRAWGSRQKLFRRAEPHSSSYYSNTWWSHGEKAIPQIPELLSYQGTPPACKKLQAPDSNSKSYVGC

SEQ ID NO: 780454 - protein, 86 aa, Homo sapiens
SGSSVYCPRLARQVHDSLPQPSLLALLQPALPTGPEAHCFCFWGTLNSQLPALFQPTSGTLVHNRKSWRGHAGGVQGQDLSKPPTF

SEQ ID NO: 780455 - protein, 177 aa, Homo sapiens
RDSPAWAMEENPTLESEAWGSSRGWLAPREARGGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAVHGVLLLPACASCYLLNV

SEQ ID NO: 780456 - protein, 90 aa, Homo sapiens
SLQDPRRSSWNQAIPLLSLPSSLNYKHTPLHLTNVCVFICRDEFSLMLSGLITSAQEFDTSLDNTGRLCLYYKFYNISQARWHVSSPSYL

SEQ ID NO: 780457 - protein, 129 aa, Homo sapiens
GSLCLEATRDSGTCVVERHEEGPKTQPRGACVHRATCRGCRRMGAGTGQLEGIGIEAGLLPLPAVDKAEGGGLAPTVRPGCAEVGGEMHCYSPAKCGLPEGRDEAESLLCCRAQVELGTGGGCRNRGAR

SEQ ID NO: 780458 - protein, 101 aa, Homo sapiens
HHKRIFNININIRKMSPTQDHHSSEKFRTAYVCVWIMASGVENEEEMACVSFTPTTCRPFTYSISLCLGNISDLDTAKPLCGFSLLLSFFHLTITHWAPAI

SEQ ID NO: 780459 - protein, 75 aa, Homo sapiens
KAQQPDCRNILAISCRAASSTAHTPPSCPAGWAGQWDSLCAHFVASRSDTSFLGGPVVPAKPNPRILPEVVLPNP

SEQ ID NO: 780460 - protein, 103 aa, Homo sapiens
LRLAGRSWLNSASPSPSSTPTTSPRKGHGRFLQLPGKCPLPSSPPSPEETPGRREGGLASRYQSHLAFIGMAFSVAPATAICPASSKQASLGAHLTLRKTRAT

SEQ ID NO: 780461 - protein, 195 aa, Homo sapiens
KLFSGGAACRLPFSEPTLPTADPSAAPGTRHFTWGQLGPRLLRCVADEENQARGQQAGVLLGTEEESVEHSDQMTFHFTGGSSFSVQFPNPKADPAPHLNTARACWFTLGRAVPLGQAPIVTTSPRMGKHVSGRDVGHVWTARPSQSIFRGCSVLLLRRECISLGRTHCTKFKAKSSEFWRQLPQDFLQLQVPFH

SEQ ID NO: 780462 - protein, 211 aa, Homo sapiens
GQVLTCLGSRDGKSPVKMANASINTLLEALDCILLPICPTDKPLCLSLQNIYKIGGIGTISVGQVETGVSIEVTLAPVNVTTKAKSVAIYHEALSEVFPGNNGGFNIKNVSVKNVHHGNVAGDRKNDPPMEAAGFTAQVIILNHPVQISAGYAPVMDCHMAHTACKFPELKGKTDCHSGKVKDGPKFLKSGNAPIFDKIPGKPTRVLRASD

SEQ ID NO: 780463 - protein, 129 aa, Homo sapiens
LVEASSLNLDSVTPRPLHLHLPGWQDQWRTDPKPELKSVLIPARVGSPQIKGSSLTPPAPPSPRGWQEQAWHVPAVPAQAWVGRNSSWVLAHTALSEAGKPGESWRKSPSPSTLNYALPSAPPGYGSCP

SEQ ID NO: 780464 - protein, 109 aa, Homo sapiens
GSPCGPSAPQMHQRPWNPNPRQASHHCRSPDVRAWSLSRGPLTGQGTYEDCLGPGRPQHPDGGVTLPMGIPQSLAVMTTCCSDPRAAWHPSIVVDSSCPSTFRQLWTHP

SEQ ID NO: 780465 - protein, 126 aa, Homo sapiens
MRVSVLVWEKAQCQNSLVRLVAFPASLLAVEERMGSAWFSYFQAIQWLVALEYEPDLTPTTSLLFQMGEKDKETDTETFFCCFSFLFLSRSLRHSLPTALPLLEYNGIQKRLLSPHLPFPYYYFSY

SEQ ID NO: 780466 - protein, 85 aa, Homo sapiens
YLEIRRVMVMLYPSICEHVADHSQEREQLTMVNPVLIKMYINKPGWWAPVIPATWEAEAGELLEPGRWRLQSAKIVPLHSSLCDR

SEQ ID NO: 780467 - protein, 207 aa, Homo sapiens
DLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVSPRSGR

SEQ ID NO: 780468 - protein, 118 aa, Homo sapiens
LEDHRRRHQFSKRIVLPEPSIRSVMQKYLAERNEITFDKIFNQKIGFLLFKDFCLNEINEAVPQVKFYEEVRSNSFYKAGTRGRGASVSGRGTSVYKSSEAGHSLWCSRKRKAWCMIT

SEQ ID NO: 780469 - protein, 74 aa, Homo sapiens
CLSLPKCWDYRHSHCTRLEVHFDQGSTCQSLAFYIFRDYKSTINLCFSTRWPLICPTKEPVRVHGPYVLTAPTW

SEQ ID NO: 780470 - protein, 105 aa, Homo sapiens
MGNSSLHFRWHSPNVPGLGRQPQAPSSAAPEALAVAAPGVSSEPRLVLVPAPRPPPSGGSVKPGGEGGGGGSSTRAGAGGGGGPAGGDLAANTFPMVSGRGACSR

SEQ ID NO: 780471 - protein, 124 aa, Homo sapiens [sequence omitted]

SEQ ID NO: 780472 - protein, 120 aa, Homo sapiens
MRGQEEPDRLGTGQESQDEVRGEGTEKGRNGRVAPKQGKRTGATWRLKCGGGEWGRRAGNVKGEGTSLPLRSLLGCIDIPSHPPPLSIPLSRCLLLGSGQPQLSALRPGGRGRSREKECR

SEQ ID NO: 780473 - protein, 115 aa, Homo sapiens
MSVPRAGTVPGFLYLDLRTLSLQPCERFARVTGGNVPASVPAFPDGTLQQSPPLPVLPPNHFPPATAEGASSPAARAPSSSRAPALPAPFPTLFHMTPPPHILNFVFPRRPLSTS

SEQ ID NO: 780474 - protein, 130 aa, Homo sapiens
LAALSSAALLRCLFCLSCLSQSLPRTAVWPALTCLQGQQLNSFSGHELLYSVNRAIIPFTDNSGLEPSDGLPCYGYMAVITSGVIHLCSKLTESLWPGCPPWPILDQSTAMYLKPSCMQWHRNDFSERSI

SEQ ID NO: 780475 - protein, 98 aa, Homo sapiens
QKHCQSPQMERPEWPKANGVEFTGCPPPPPALAQEAQWVSSKAACFISRSCGTPGPRDTLVWAPPAPLLSEAEMNLLRQTVTEPYKFSLWARRGGSHL

SEQ ID NO: 780476 - protein, 119 aa, Homo sapiens
MESSPGGYRCTRVKRKLSISSLTMIVSKFSPKPGSWIHGQCSADSSLSTHVISCLCFLITCPFSVAPRATQANKCGHRKGSSNEEKHFIISSHKPQSCFPKSLLCPPVPELWKRTSGIS

SEQ ID NO: 780477 - protein, 345 aa, Homo sapiens
PRAEFGTRLKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEVHK

SEQ ID NO: 780478 - protein, 215 aa, Homo sapiens
MRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEVHK

SEQ ID NO: 780479 - protein, 374 aa, Homo sapiens
PRAEFGTRLKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHERWGFTMLSSLVLNFGIQAIRQPQRPKVLELQV

SEQ ID NO: 780480 - protein, 229 aa, Homo sapiens
PRAEFGTRLKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKKKKKMTHTTKIAWWADLETHKKNVFDETPHCVLWGTGSPQ

SEQ ID NO: 780481 - protein, 394 aa, Homo sapiens
PRAEFGTRLKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 780482 - protein, 283 aa, Homo sapiens
PRAEFGTRLKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQVVGVRAEF

SEQ ID NO: 780483 - protein, 131 aa, Homo sapiens
SPSTGALRTFLHIEGTLRAALSVIAILFIPGIGKLFLEGPKSRHFWLCGHRVSVSNSLCHGGWKADIENRCTSEHSLVPIKLYLQNREQWTSESPRTRARLPENFQAHPLEAGETTKAEERAFPSRSPKAR

SEQ ID NO: 780484 - protein, 105 aa, Homo sapiens
CLQGLSTSQTKSLMLPPTSVSSEGPFKSKELCPEQLETLREVDSHLKCALAHVLSSRKSNGRINRRFRAKLIIINNPRHIHANPEGSLGEQDFYNHTTILRSHRE

SEQ ID NO: 780485 - protein, 112 aa, Homo sapiens
MMWEAGGSGRSTLGGLASSLTLMEPLQAWPPDSGPTTSQLSFQLHSQGSLGSWGWAGGSGMSQRPVPATGALHHPPRGGGPWGESGGHLTLLCWEQELHLGDQRCVSAAPGR

SEQ ID NO: 780486 - protein, 50 aa, Homo sapiens
QVWWHAPVVPAMQEAEVEGLLDPRKSRLQCLTRLQCLTRLQCLTRLQCLT

SEQ ID NO: 780487 - protein, 48 aa, Homo sapiens
MGQSLVSTHTAPADMPAHAKAHKHTQLCRATQAQSHTRSHMLMHTYTP

SEQ ID NO: 780488 - protein, 95 aa, Homo sapiens
EPHAGLGSPSPDAAPPPSPEVSATEIPLVPEAGGEDPGGCALEAGPSWGLSVPTFPPFKSYHCQAQLLRPANPALWDGKTGGSLEPRSLRTAWTT

SEQ ID NO: 780489 - protein, 81 aa, Homo sapiens
EKPSMGKLLKMTQTMAIPRGLWEAESKYSGILKEWRKMTDTNPTTITATAAAKCGGKKNRSDRYCVYVEKGRHKKLHFDLY

SEQ ID NO: 780490 - protein, 75 aa, Homo sapiens
VFLFIGMRRGGRVELGLVVLEILGLKHMESPSPVSMSLDRPLLLELEMGAQADVARDGHFPGTLMVDVRRSISSL

SEQ ID NO: 780491 - protein, 36 aa, Homo sapiens
MNNDSHVHKHIAAEDKWAFVFFHDILVQCFLIGYRS

SEQ ID NO: 780492 - protein, 87 aa, Homo sapiens
MRTAHHSHHLEKSPISCCYGPLTPCSPTSRASSSGKQCSCFTLWLNTPSSSSSTFLRDGAPRGNQKSLCHCLSSLTSLFTLELGKEQ

SEQ ID NO: 780493 - protein, 43 aa, Homo sapiens
MSRKPRASSPLSNNHPPTPKRLPRQPGREQGPVKEVPGTKGSP

SEQ ID NO: 780494 - protein, 369 aa, Homo sapiens
GRPVGTDARHFFSADSRQMCNTNMSVPTDGAVTTSQIPASEQETLESSDSGTSVSENRCHLEGGSDQKDLVQELQEEKPSSSHLVSRPSTSSRRRAISETDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 780495 - protein, 497 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 780496 - protein, 209 aa, Homo sapiens
GRPVGTDARHFFSADSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSKRS

SEQ ID NO: 780497 - protein, 240 aa, Homo sapiens
GRPVGTDARHFFSADSRQMCNTNMSVPTDGAVTTSQIPASEQETLVRPKPLLLKLLKSVGAQKDTYTMKERWSFTMLPRLVWNSWAQGICLPRPPKVLDLQVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSKRS

SEQ ID NO: 780498 - protein, 146 aa, Homo sapiens
RVLWAGPAPTLLSAWLLASLGAMPPPAALGGMSWGITEACVFLTLSASHLSPSLFLPFSFSLSLPFHSFSPCLASHHSVSGTLSLPICLSFLCLCLCLSLSHPPSFSSSLFLHVSFPHPANIYSVLLRLGGYWDVLRDGRANTKFT

SEQ ID NO: 780499 - protein, 50 aa, Homo sapiens
RNSTDLKANTQSKQCKLVYYLWEVVWNLGMWPPPRSASFGITEWWWPECP

SEQ ID NO: 780500 - protein, 40 aa, Homo sapiens
AIEQVRQKRIGFLHSQFISTNSRIKTIIQFWDKVHLYSFS

SEQ ID NO: 780501 - protein, 104 aa, Homo sapiens
MSATTGWQLPPSRSGPASEHLSPHLRAEAAACVADQGWVGAMGRGPTCPRLPVIWAPLTRPPLVDPRGRTTACKKRVPAGPGHRMLGASLPAAGHVRVLGWQEP

SEQ ID NO: 780502 - protein, 245 aa, Homo sapiens
VKVFHKYSNAKRHKIRHTGKNPFKCKECGKSFCMLSQLTQHEIIHTGEKPYKCEECGKAFKKSSNLTNHKIIHTGEKPYKCEECGKAFNQSSTLTRHKIIHTGEKLYKCEECGKAFNRSSNLTKHKIVHTGEKPYKCEECGKAFKQSSNLTNHKKIHTGEKPYKCGECGKAFTLSSHLTTHKRIHTGEKPYKCEECGKAFSVFSTLTKHKIIHTEEKPYKCEECGKAFNRSSHLTNHKVIHTGEK

SEQ ID NO: 780503 - protein, 44 aa, Homo sapiens
MLVRYWAFDSLLSWKPVSWFPETSRPPSSLPGMAMAATQQNPCQ

SEQ ID NO: 780504 - protein, 146 aa, Homo sapiens
QLCSFGFQLMGKWPPWVSVFQEETVTLHCEVLHLPGSSSTQWFLNGTALRPRPPATESPLPVSMTVVNTGAREVSQGEVTPYQLEIHRGWPLLQVSSRVFTEGEPLALRCHAWKDKLVYNVLYYRNGKAFKFFHWNSNLTILKTNI

SEQ ID NO: 780505 - protein, 129 aa, Homo sapiens
MASAKDARLQLWKEPWEVGDLCIKIGTQTIIPIRDIYAHITPDSKLRSGLSGEIKVSLSLSLYLTHTHTHTHTQRERERERERERERPAFKIPMLRESIGTSPQDVLNSRKLSLGVAETAAVMSLLTRT

SEQ ID NO: 780506 - protein, 66 aa, Homo sapiens
QLNVNITLVIMHIIITTSSTFMTTISTTSITAIISTATLTIVAIILVNQEVSETSLNQFRSLFCQG

SEQ ID NO: 780507 - protein, 79 aa, Homo sapiens
GQGKVSTGESFLAIRIPQQTSSCCLLPPTSTDQLYPFSVIFNIFLFLEIPATFGERWLPGATKRGMLLHTSLLSANTQT

SEQ ID NO: 780508 - protein, 255 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQAHHPGSGRPHPQRGRRVQMGHRCSEGLPVPETGLLL

SEQ ID NO: 780509 - protein, 102 aa, Homo sapiens
CECGSLLDSSWDKQKNSCNAESLGTSMPSETGVSACVSFSPTSLCCDPSVYSLVTFPLQEGGPGVSPSHLVSSLLGSLLPQSTGGQLRRSYLKKGGVCQGAG

SEQ ID NO: 780510 - protein, 79 aa, Homo sapiens
IYAWEMGTEEDENFMLDEGFTTVMDLLLEYEVICIYWTKYYTLHNAIIEDCVRKQLKKERYWTTVCPPNLTEKKRDGLV

SEQ ID NO: 780511 - protein, 514 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 780512 - protein, 496 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPLGIYGIQDSDTLILSKKKGEALFPAS

SEQ ID NO: 780513 - protein, 102 aa, Homo sapiens; identical to SEQ ID NO: 780509

SEQ ID NO: 780514 - protein, 168 aa, Homo sapiens
ATFTIPLLQSQLQKSFQNYCQVSSSSLVRGPPSRPGPHQGETYHRRQHRWPRVEDMMGAKVAGALASSIPIWHFQKFFFISHCYLSLLQLQPRISLRTSGHLQESLSQTKLWPDLPTLPPTHRDPILKRQFGFLTLAPNCIRSHSQPSNKLPVCQALSLFLPVRPSSR

SEQ ID NO: 780515 - protein, 104 aa, Homo sapiens
RNTIRNTYTHIHTHTHTAEIKTFPIKIQRGLTGPTSWSYKGWQVLSVGWRKVLFPQLHSRGNTLQALHCEPVWLGSEACQHIQEVKSERGRISNRASCTQMPRQ

SEQ ID NO: 780516 - protein, 84 aa, Homo sapiens
GGEPRTNSFTKAVEKQEALAIHALFSQFTNLVQNEVSDLLANGVVPSGIVTGSIFLACDELLRVEELVVGASANFIINYHGFQV

SEQ ID NO: 780517 - protein, 107 aa, Homo sapiens [sequence omitted]

SEQ ID NO: 780518 - protein, 124 aa, Homo sapiens
GYSIDTFRHVNSWEGRGMPAIFIIALPPPNTIRGPALIISLQVYPAAPERQRPARRGHDDGGGFVKTKMGICREKKERSDCYCVYIEREDIRDSILKKTCTLNNCFAEMLLICSFAPATLPQPL

SEQ ID NO: 780519 - protein, 263 aa, Homo sapiens
YLKRTFIFKVFVVYLKFTFTWASSILSGSPCSLSVEQLGCPLAAIWPHDAHRTALGGGGSAPGRLLRGLLLSVDTWGSRGQGGAVAWQEPGDPGLGEIGGGQAPRPKLVDPKVRSTDQRHQHPRSLLEIQILRLLPDLLRLRLRGGARPQALLMPIQTSELLTTLPAQVPLLSHFTDEKPRVRGVKELRPWPPCDPQVRAPGGWEEKQIWGLSLLHLPGGTPAFMSECHRPPRPENWEPPCAASLTPQETEAREGNGLLDAAE

SEQ ID NO: 780520 - protein, 127 aa, Homo sapiens
VSLGGDSVQPGLGPLCGDSRAASRMLFVWPQDRGSVSLLADAVAAATPQGTKSQPRGPSNLAADLRVAEESSGMENLFLKMSFDSIRPAQVICLLLKVKYYNNNCQASSQVMAPGVCEHEHMLEGRP

SEQ ID NO: 780521 - protein, 109 aa, Homo sapiens [sequence omitted]

SEQ ID NO: 780522 - protein, 167 aa, Homo sapiens
QLCSTPEFSSPSAAFPPCWLAGWLALDAVSLFLPRILLSLSLIPSPGRWGLISPFPHQSSPSISQLPFPMFPLAYSSSPSLFSSSPLSSSWVRTSAISSFYPPLPPPSSPTTCFPFSSLLTASSSLQSREAWFLGPSILQSTFHLPLPPSPLLGTQDGEDWRAPGKL

SEQ ID NO: 780523 - protein, 322 aa, Homo sapiens
MPLLTLPQTRQRAKNIYDILPWRQEDLGRHESRSMRIFSTESLLSRNSESPEHVPSQAGNAFQEHTAHIHATEYAAGIYDNAMVPQMCGNLTPSAHCINVRASRDCASVSSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 780524 - protein, 398 aa, Homo sapiens
MDGVTPTLSTIRGRTLESSTLHVTPRSLDRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAAGIYDNAMVPQMCGNLTPSAHCINVRASRDCASVSSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 780525 - protein, 112 aa, Homo sapiens
MCFWKSWNWSEPRAGTSVSKATPQLSEGPYSFQIHHPQDRHGPDTVPPRVTGQRTLTYWCSSDIRNCHHQALFAMKLNSKICHLTLKVWGTCNSLLKGPSAYKQHAIYLPWP

SEQ ID NO: 780526 - protein, 75 aa, Homo sapiens
RDYGLKVTQGSEYTSDYSLTKLLSEVYSVHHAGDDFVQLGDKLHRAEDKEICGDLVLLSFPISSPTLLLCPSTPR

SEQ ID NO: 780527 - protein, 235 aa, Homo sapiens
EKSGLRRRRRWRRLGEARVLADFSIETRRNKNGCRGTSVYNKEMSNPRRARLERRGFGLFQLAGQRCIEEGHTDQLLEIIQNEKNKVIIKNMGWNLLVLLFDAFCVKIKRIMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDGLWFINYEVMVSRYEMKSNGYGRMGI

SEQ ID NO: 780528 - protein, 108 aa, Homo sapiens
GCPRMGQGEGMKRPRKHVPGCCSSGAPGASVSPSHWQSESGAGGCQGCLQWDQGLVCEDSPAFHFEGGSAWDSKQASRGMFTSHPPTHRQPSFQCTCPQEGASPLVIC

SEQ ID NO: 780529 - protein, 107 aa, Homo sapiens
RQILYQTPVKELASLKWKRHGRPYFCMLGAIYLLYIIWFTMCCIYCPCLPGPDHRLSDVNSGSPQPDSAPAFISQTWAMPRTNRNNANNQVGETGVHLGCTTDPEQE

SEQ ID NO: 780530 - protein, 127 aa, Homo sapiens
GPRSGRSHIDAELSADTLIGIAHYSPELLASSNSFALASRVAGTTGMHHYAQLIFEFLVEMGFHHVVQPGVEFLTSGDPPASASQSAGITGMSHRAQPTRILNLRNYLSQTHRRALCRCILTIFNNY

SEQ ID NO: 780531 - protein, 76 aa, Homo sapiens
MAELLEAPLFCSDLIVGLPWTRLYADLVLSVLLLTQDVAQIEHPLASTSLLKLLSKCHWCPSNHQSLTSAPALPTI

SEQ ID NO: 780532 - protein, 118 aa, Homo sapiens
PAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 780533 - protein, 94 aa, Homo sapiens
VCVQECVSRCVCLGVLVGNCFLVCGILYAVDTYNQQEGQVAYAFDTHTGTDARPQLPFLNEHAYTTQIDYNPKERVLYAWDNGHQLTYTLHFVV

SEQ ID NO: 780534 - protein, 118 aa, Homo sapiens
QKQFRLFKTAALVIQQNFRAWTAGRKQCMEYIELRHAVLVLQSMWKGKTLRRQLQRQHKCAIIIQSYYRMHVQQKKWKIMKKAALLIQKYYRAYSIGREQNHLYLKTKAAVVTLQSAY

SEQ ID NO: 780535 - protein, 50 aa, Homo sapiens
GSYGPSFVDHLLWQQVPHALPLQCKPSTLPSEQNADVSSSLVLNPIWKKK

SEQ ID NO: 780536 - protein, 81 aa, Homo sapiens
SPLPLQLFTSLDASGNIAILYAASLCNAVLPSSVPLPVGTLLMHLCMVSPSSPQCPVLASMPTMHLCEIHPHSTDIFCSGL

SEQ ID NO: 780537 - protein, 118 aa, Homo sapiens
GWQGREEKHRQCQVPEIQDALRELCDRGAVTLLRSPCWSIEEPGLEPRSCNSKSTSHLPTPLNAPMSLLVPYHMVSNGSGGPKLVLYSETHGLGRYLQRSSFFEKTLPLSLKRLLPNK

SEQ ID NO: 780538 - protein, 91 aa, Homo sapiens
LASSVGHTLESSLPVHWALLLLQGAGGWGLREGTSQQPWALGLWAPAEHECSHLSLPRLPKHPRLCSHAGPDGQEVHPEGQGTHDVTQLPQ

SEQ ID NO: 780539 - protein, 52 aa, Homo sapiens
RGKLENLFLQCLKPTLQQISHIAQQISHISQCAHKPTLQQISRLGWRGCGPS

SEQ ID NO: 780540 - protein, 72 aa, Homo sapiens
MKFIKALNNQVGKAGAHNCHLLVSEHLRLGEDNDSRTRSNCRWGVKLIPNSVLQPLALRKDMEGLHRLFLAG

SEQ ID NO: 780541 - protein, 255 aa, Homo sapiens
RQARSAARSAVEAARTVRGRPMALRGPAGLGPGSRRPLDEAVAGAEGREAPALVAAGGAPEDDEEDDGRGRGLLRWDSFSAWLHCVCVVGFDLELGQAVEATLPNFISEATSGPIDVEGTPSCYGTQKLRHRTALTDFPQGHHLIRNQNMVWVPSTVLSILPQCLLRVGQNAELYHSFWPKVKGNLSSESKLTDREKPNICYGSFPDSTFKVVLADTQYSDQISDKSSGEEGVACIGSVDPFDKDLPALLHSTGS

SEQ ID NO: 780542 - protein, 171 aa, Homo sapiens
RQARSAARSAVEAARTVRGRPMALRGPAGLGPGSRRPLDEAVAGAEGREAPALVAAGGAPEDDEEDDGRGRGLLRWDSFSAWLHCVCVVGFDLELGQAVEEFILSIPNLLTEKKPIFAIGSFPDSTFKVVLADTQYSDQISDKSSGEEGVACIGSWINLTKIYQLYFTAKD

SEQ ID NO: 780543 - protein, 55 aa, Homo sapiens
MPAQGLQPLAIVLKLDADLVSLAGVEVVGGEQKVDAEQKVDAEQKVDAEQKVDAV

SEQ ID NO: 780544 - protein, 73 aa, Homo sapiens
RIELGTESRQAQGDIRQKLQKLEGFEAMNITQLIQVATKVFVNPEEEAKKEAKHKAKEKADLLAAALVERLVL

SEQ ID NO: 780545 - protein, 465 aa, Homo sapiens
GVTSLPAMAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITVDSVCLKWAPPKHKQVKLSKK

SEQ ID NO: 780546 - protein, 393 aa, Homo sapiens
GVTSLPAMAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLR

SEQ ID NO: 780547 - protein, 474 aa, Homo sapiens
GVTSLPAMAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITGGWGAAVCRGRWGSVSIWTGRSQGLLIAVT

SEQ ID NO: 780548 - protein, 393 aa, Homo sapiens; identical to SEQ ID NO: 780546

SEQ ID NO: 780549 - protein, 190 aa, Homo sapiens
GVTSLPAMAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKVRIPSHPRAQEAQLLCQFPWVSRAPVPKP

SEQ ID NO: 780550 - protein, 190 aa, Homo sapiens; identical to SEQ ID NO: 780549

SEQ ID NO: 780551 - protein, 122 aa, Homo sapiens
LPGQPSVWVARVTRAASATRALSCRGSLWKWATRAWAAHGSWGTEFSGQSGAAGALELLGQPLATGVLELPGQPGAPELPGQPVATVALEISVQSVVTTSEAVNDDRVAVPGGALDDSAGIL

SEQ ID NO: 780552 - protein, 465 aa, Homo sapiens; identical to SEQ ID NO: 780545

SEQ ID NO: 780553 - protein, 474 aa, Homo sapiens; identical to SEQ ID NO: 780547

SEQ ID NO: 780554 - protein, 420 aa, Homo sapiens
MCGPELWKLLLSVQDSFCSSLTFLMTLPFSITDSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITVDSVCLKWAPPKHKQVKLSKK

SEQ ID NO: 780555 - protein, 365 aa, Homo sapiens
GVTSLPAMAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEESPGNNVAAVAELAQVRQRLLRGADCVSSLESELKAMRNFPEPRRWYGGQGQS

SEQ ID NO: 780556 - protein, 190 aa, Homo sapiens; identical to SEQ ID NO: 780549

SEQ ID NO: 780557 - protein, 172 aa, Homo sapiens
SDFNLIVQNLEAENYNIESAIIAVLRMNQGKRNNAEENLEPSGRVLKQCGPLWEEGGSGARIFGNQGLNEGRTENNKAQASPSEENKANKNQLAKVTNKQRREQQWMEKKKRQEERHRHKALESRGSHRDNNRSEAEANTQVTLVKTFAALNICLFGLLGVVRSGWKRIAVC

SEQ ID NO: 780558 - protein, 117 aa, Homo sapiens
LWIRGISHLSTLQTRLRIAPLPLLFLTLVSGSIILWLLDAKLFFSFSPIAHSVHHQPDHPNHVHSHLCVCQATTLLCLDYVGGLLTVSLLQLSCCLRLPPLNRQLSYLHECYGHCLE

SEQ ID NO: 780559 - protein, 96 aa, Homo sapiens
TLIALSSTRQLKSPGQIWNFFCLCPLATEEIPNMVAWAITPQMKEIFLSSDPSLRLQDTCSKQQLLHVLGSDTLRSLCSPKCFLHIFIHPRPSPSS

SEQ ID NO: 780560 - protein, 121 aa, Homo sapiens
TVDALGVLTGAQLFSLQREELRAVSPEEGARVYSQVTVQRSLLEDKEKVSELEAVMEKQKKKVEGEVEMEVIVTCQAPFAKSDEAPWENGLLRLSPIAEVDLLKDGQSAPALVFPHPGGQT

SEQ ID NO: 780561 - protein, 64 aa, Homo sapiens
MQNAPFTTKKGPSWSLIPGGTTLLCDRGMTAPMKESRTETCGENMRCPRSRGERLKVTESIIRL

SEQ ID NO: 780562 - protein, 101 aa, Homo sapiens
NDVREKRSHAHGCCPSQKTCKLKCFFLDRAGNLNLWNMQNAPFTTKKGPSWSLIPGGTTLLCDRGMTAPMKESRTETCGENMRCPRSRGERLKVTESIIRL

SEQ ID NO: 780563 - protein, 64 aa, Homo sapiens; identical to SEQ ID NO: 780561

SEQ ID NO: 780564 - protein, 78 aa, Homo sapiens
MHLSLPAVSSPPHLESRDDIDSAKECKFKVALVSQSGLPCFLKPPACLLPLQEPHFLLSAAPGLPDASDGKQAQPHFL

SEQ ID NO: 780565 - protein, 100 aa, Homo sapiens
SGPVRSLNCPCPSFTILCSLPPLPHCTFSLPHMSQIHSHLQALKASIPSLNCSPHSCETAVPPPHSGFTQTLPAQRSFFHPSKAAFTPQLSVLFSLQCSL

SEQ ID NO: 780566 - protein, 77 aa, Homo sapiens
GGGITTEFCSMARCLLRVKKGKSASGKRNQMCQSLGCGEAQQIQAAGQRGTGGTRGRYGGLRQSSRVSSQGGHGPQI

SEQ ID NO: 780567 - protein, 76 aa, Homo sapiens
ARLLTCARALSVAGCRPGRRCSAGQSRGTRPLVGATEKPAPGGREQAESVEGTHWSGPGGWEGFQEKPRLLLILIA

SEQ ID NO: 780568 - protein, 39 aa, Homo sapiens
RFSASDKGWEQQSSCKESTQGFLTSDSNSTLKGFPSQLQ

SEQ ID NO: 780569 - protein, 128 aa, Homo sapiens
HISHVHPHISHAHSHISHVHPQISHVHSHISHTHPHRTRAPSHISHTHISHMHPHISHVNPHTSHMCTLTSHMRTHISHAHSHITRVPTNLTHAPTNLTRALTSHTRTHTSHTCTLTHLTCAPSHISR

SEQ ID NO: 780570 - protein, 66 aa, Homo sapiens
QKMYYTTFKVLLGKLWDSTRGGSAIRRPCCLHASYLRTALRAEMRTDHAAGSSRGMAGLSPRPFPD

SEQ ID NO: 780571 - protein, 83 aa, Homo sapiens
LEPNSQVTEGNQKCHSDEHTKKKSTLLLIWKKFAGLDTGSNQPQHASSQSLIQNKALTLFISMKIERGEEAKGEKFQASRGWS

SEQ ID NO: 780572 - protein, 105 aa, Homo sapiens
MGRGWERLTFCSDSRLWSWALEQPHLAAVSWPQGPAECQVPAHPHSPWGLAVALALLRVLANLLGKWGLRGRALLWGVDSTASAGCCGSLFCGDVGPANVSTSCD

SEQ ID NO: 780573 - protein, 196 aa, Homo sapiens
GFAVAAWLGGGRLAWRGSDRLAWHFWLGGPPFADWKPRAILLGGCGRGSSSLLMASWGGEKRGGAEGSPKLAVYATRKTRSVRSQEDQWYLGYPGDQWSSGFSYSWWKNSVGSESKHGEGALDQPQHDVRLEDLGELHRAARSGDVPGVEHVLAPGDTGVDKRDRKKSIQQLVPEYKEKQTPESLPQNNNPDGHPY

SEQ ID NO: 780574 - protein, 75 aa, Homo sapiens
LTPVSADGYGWVLTPVSADGYGRVLTPVSADEYGRVLTPVSTNRYGWVLTPVNLAVLGSIRSQEDREAGCCGSCP

SEQ ID NO: 780575 - protein, 68 aa, Homo sapiens
LYPEGEYWYQASCLDSGHSEASSSAQTAPVSPCWLSICPKMCVGHVKLNAPQLSAYYPLFQNLCQQPS

SEQ ID NO: 780576 - protein, 104 aa, Homo sapiens [sequence omitted]

SEQ ID NO: 780577 - protein, 92 aa, Homo sapiens
KRRRGPASSHCQLAHSSSNTVSEDGPQAVSSGHRCENKAGTAPGQTLAPRGGSPRSQASRPHINTALHVEDKAISDCRPSRPSHTLSSLATE

SEQ ID NO: 780578 - protein, 76 aa, Homo sapiens
MLESPLLHSCQVVTAYWIHLGGCHYGLDRCISPSALCLLPSSPSPLRASWGTVLTLSQPEEPQQVFPRRLHDAAPH

SEQ ID NO: 780579 - protein, 112 aa, Homo sapiens
LRGVDTLSPSLRGVDTLSPSLRGVDTLSPSLRGVDTLSPSLRGVDTLPSSLRGVDTLSIVRGVDILSPSLRGVDTPSPSLRGVDTLSPSLRGADTPSPSLRGWKPLSITQQV

SEQ ID NO: 780580 - protein, 105 aa, Homo sapiens
MVWLCVPTQISSYSSHNSHTWWEGAGGSSPCCPRESEWVSRDLTAVKAGVSPHKPSPCLLPSTLRCDLLLLAFHHDCEASPAMWNAKSSKPLSSVNCPVSGMSLS

SEQ ID NO: 780581 - protein, 105 aa, Homo sapiens; identical to SEQ ID NO: 780580

SEQ ID NO: 780582 - protein, 102 aa, Homo sapiens [sequence omitted]

SEQ ID NO: 780583 - protein, 58 aa, Homo sapiens
ESWKASVLSQYTRCRTTVEQKVHLRGTVALKSRCAWALGSQDVPTASSWAQGSSTGTA

SEQ ID NO: 780584 - protein, 219 aa, Homo sapiens
PSARRLRPAGGPRAPPRPGPPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGR

SEQ ID NO: 780585 - protein, 121 aa, Homo sapiens
VSQVSVPGEDCRMRNKGSENLREAGLESRAGHRSLTVTVPQTPLHLAVITTLPSVVRLLVTAGASPMALDRHGQTAAHLACEHRSPTCLRALLDSAAPGTLDLEARNYDGKHLPRGTAGLS

SEQ ID NO: 780586 - protein, 162 aa, Homo sapiens
EDCSALNPEPQIHASPSNGVSNWHLQPSFFLVLPKTHASPRDLATFINSVFSVAEAPNPVSLDSSCRSYPIISHPEILVAPSSKCIRNLSISHWSEPPSSLAPHCSPSSCPSPWRLLYHSSQSDPLSTQVRPCHISAQPSPGLPNTSLRVKSKVLPLLQICH

SEQ ID NO: 780587 - protein, 113 aa, Homo sapiens
MIHSFLQSIHPSIIQLSNPFLLNAYYMPGIMVGTTSMSIYKKSLPSGRRTLLRGGSSLLFRGRSTVVEADNDISKAWLSTSCLTRHSKILGDRESVKVFIHFKFADPGTVCGL

SEQ ID NO: 780588 - protein, 116 aa, Homo sapiens
PRESARSLNLVPSGDFSPSSSGACSLERGSVVGFSFPTLSFHPSLLWLTDDSDSWQGEGEKRRGRKGAGSPYLVNAVASWHFSGRFWWVCKPSSFSLGTILWILQRAPLFLIFGDL

SEQ ID NO: 780589 - protein, 30 aa, Homo sapiens
MQHHKALPTSAPQEPPIELSPQADCASLSQ

SEQ ID NO: 780590 - protein, 84 aa, Homo sapiens
RLSTGHFWDLRLMPFPPFNDRVPPYPHSQLMIWFLIWLREQKPWTQSQLIPASASSTEAPPCPSLLGEPPLLLWQEAPSSCVPG

SEQ ID NO: 780591 - protein, 80 aa, Homo sapiens
LDAKTQAWLWISPQKEVQGASLAGGTWAALRIVYPLGDLPSLLPEARNPTTPCATETLKPEERQTPPLALGSGGFPFALT

SEQ ID NO: 780592 - protein, 111 aa, Homo sapiens
RKGNRISIRICICIRIYNSIDARGQWDQRENDFEPSILQLGKLSIKYPFRQRLFEDILHAKLERNLKDRKAWGRTNSGISAVWCPERKSQLRAAQEPESQFRTFPTDYKSG

SEQ ID NO: 780593 - protein, 870 aa, Homo sapiens
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIARLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGNPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 780594 - protein, 182 aa, Homo sapiens
KGKCEPEQQTGEPGTKETEKLPLVPPASSLLCSNNFVLDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLNTFFIC

SEQ ID NO: 780595 - protein, 787 aa, Homo sapiens
MTKVNGTEIEYEFEEITLERGNSGLGFSIAGGTDNPHIGDDPGIFITKIIPGGAAAEDGRLRVNDCILRVNEVDVSEVSHSKAVEALKEAGSIARLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGNPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 780596 - protein, 920 aa, Homo sapiens
FFKLLFELTDCSGSKENASCIEQNKENQSFENETDETTTQNQGRCPAQNCSVEAPAWMPVHHCTKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIARLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 780597 - protein, 746 aa, Homo sapiens
MTKVNGTEIEYEFEEITLERGNSGLGFSIAGGTDNPHIGDDPGIFITKIIPGGAAAEDGRLRVNDCILRVNEVDVSEVSHSKAVEALKEAGSIARLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGNPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFISNIAGGTDNPHIGDEPWHIYYEDYIQEMLQQRMAESGSMRYLAVNENSSEL

SEQ ID NO: 780598 - protein, 73 aa, Homo sapiens
ETRVRLTQRYLRYFHPSPSHRFASLGSCEDLLTSLGSCEDLLTGLAAPAFALKPSIYPRRWFSPWRLLPGGVP

SEQ ID NO: 780599 - protein, 140 aa, Homo sapiens
LQETSKYVSLARAMSQGHPSCKEVWERGYLAKDYAHVFHEQICASSVKEKGRIILVGPGRVYPHTAWWRWSGVTEEQAGWSSSHPPHTCRICLQLRSHPDASMRMLSQESSLRVWTRGASSCSTANSACLFQLLTWFPIL

SEQ ID NO: 780600 - protein, 145 aa, Homo sapiens
MTTHAGQLPTSQNKHTLPHTQTTHLHHHPPRPPPHTPSLNTHSHRSGAQQRPPKRTPTPTHAHHHAAPRQDNPRGNDPIAPAETNPPTTQQAPTDRDNTPDTDAKTQAHPTEQQTTATATTTVGTVHTTNENNRENRGRYHNTTR

SEQ ID NO: 780601 - protein, 208 aa, Homo sapiens
SHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTN

SEQ ID NO: 780602 - protein, 88 aa, Homo sapiens
MTLVRSNVAVVAHTEPSLFPGARPAPLCLPEVFPPLRSPETHPLRHVRGGGTLTPTSRPRPAEQPRPGQKGEGVAGKGRGRERGRPRT

SEQ ID NO: 780603 - protein, 236 aa, Homo sapiens
TGLALLPRLQCSGMKTAQGILQPQPPWGLALRARATHSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSEHIHLFKGGTVADLDEQDEANSHKQEERKMKILPKVTQSQIR

SEQ ID NO: 780604 - protein, 178 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPVSTSAYCYLGILSCCILLGVASSFFPLLLLACRI

SEQ ID NO: 780605 - protein, 1144 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780606 - protein, 1144 aa, Homo sapiens; identical to SEQ ID NO: 780605

SEQ ID NO: 780607 - protein, 974 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEAAKTSTWNS

SEQ ID NO: 780608 - protein, 563 aa, Homo sapiens
MRQDRYGPPSYSHFNVLADTPPGPVPLHLRSPQVLAASPDAKFPEKTKEKPVDLQNFGLRTDISSKKTLAKEKGASAGREWTEQETLLLLEALEMSKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780609 - protein, 470 aa, Homo sapiens
LSRGSARMQVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780610 - protein, 302 aa, Homo sapiens
MVRGWVRENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780611 - protein, 240 aa, Homo sapiens
GASTSPVPLASAATQPKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780612 - protein, 210 aa, Homo sapiens
MVVFSSALGFSKSSCTIWAFSLHSREWREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780613 - protein, 143 aa, Homo sapiens
DLKQVTKAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780614 - protein, 1144 aa, Homo sapiens; identical to SEQ ID NO: 780605

SEQ ID NO: 780615 - protein, 612 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLSQQKQGSLWGAGGQ

SEQ ID NO: 780616 - protein, 525 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEM

SEQ ID NO: 780617 - protein, 67 aa, Homo sapiens
IEDLSQQAQLAAAEKFKVQGEAVSNIQENTQTPTVQEESEEEEFDETGVEVKDIELVMSQQMCREER

SEQ ID NO: 780618 - protein, 476 aa, Homo sapiens
WAGPGSGSGGYARGGARGNDRETPRGPGWARLWGRRAATMAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSEHIHLFKGGTVADLDEQDEANSHKQEERKMKILPKVTQSQIS

SEQ ID NO: 780619 - protein, 67 aa, Homo sapiens; identical to SEQ ID NO: 780617

SEQ ID NO: 780620 - protein, 254 aa, Homo sapiens
MRIPAERHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSEHIHLFKGGTVADLDEQDEANSHKQEERKMKILPKVTQSQIS

SEQ ID NO: 780621 - protein, 67 aa, Homo sapiens; identical to SEQ ID NO: 780617

SEQ ID NO: 780622 - protein, 116 aa, Homo sapiens
ARQQMEQQQHGQNPQQAHQHSGGPGLAPLGAAGHPGMMPHQQPPPYPLMHHQMPPPHPPQPGKRKALLLEKAYGHYRGTEHHWGQPHSWCFLMKTAQNFHCHLENCRHVRFRVIAT

SEQ ID NO: 780623 - protein, 128 aa, Homo sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPDFTKHPCKVIMDFKAGGALCHILGAAYKS

SEQ ID NO: 780624 - protein, 1144 aa, Homo sapiens; identical to SEQ ID NO: 780605

SEQ ID NO: 780625 - protein, 1144 aa, Homo sapiens; identical to SEQ ID NO: 780605

SEQ ID NO: 780626 - protein, 1144 aa, Homo sapiens; identical to SEQ ID NO: 780605

SEQ ID NO: 780627 - protein, 1144 aa, Homo sapiens; identical to SEQ ID NO: 780605

SEQ ID NO: 780628 - protein, 1144 aa, Homo sapiens; identical to SEQ ID NO: 780605

SEQ ID NO: 780629 - protein, 366 aa, Homo sapiens
VIGRGYTDDDRPPRRIADEDRRNWRHADDDRPPRQGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 780630 - protein, 198 aa, Homo sapiens
MKLFGFRSRRGQTVLGSIDHLYTGSGYRIRYSELQKIHKAAVKGDAAEMERCLARRSGDLDALDKQHRLSIARKRLVPLFCWNMVPIQTLRISTATLLSIMLCIVRAPHWQKNCFSMVKILKHWTSDPFGAGVPDIDIWDPDTIDRSESSKFVPPRRNLHLHWEALATVPLKLLIPQMLMFATNSIVKWGLGTIQEIS

SEQ ID NO: 780631 - protein, 96 aa, Homo sapiens
MKLFGFRSRRGQTVLGSIDHLYTGSGYRIRYSELQKIHKAAVKGDAAEMERCLARRSGDLDALDKQHRTALHLACASGHVKVVTLLVNRKCQIDIY

SEQ ID NO: 780632 - protein, 114 aa, Homo sapiens
SNRVIVMKIPQHLRGAEAGLKLLTSGDPPASASQSAGITGMSHRARPLLVFSPCPALSRVSLSLTSPVWVPAFLTHGGAWIRGVPEAEDGSIASVVWMLEMLTDQSCALVGPTV

SEQ ID NO: 780633 - protein, 123 aa, Homo sapiens
HREPAKHLIIKIYNGKKPKGMELVLLQQGCSVCQFEARQISLHNGVHVSKAWSLQQGFLTLHLTPDSPSQAKEGGSSGGRGSLPFPTLHPQPSEPLLISFPLQGKGNAGRVWSFLQSCELCSG

SEQ ID NO: 780634 - protein, 36 aa, Homo sapiens
MEQDPISLKNNFLKRVDQIEMEQPVSGEKPKSVVPI

SEQ ID NO: 780635 - protein, 35 aa, Homo sapiens
MGQDRYLAGLGSGPGPRQGQGHNQVCAIARSNTVP

SEQ ID NO: 780636 - protein, 59 aa, Homo sapiens
MHQCNTHMMSSLRCEEEREEEYERRSGACSQGEANSVWVGGKRGSCLHQASISLDWESA

SEQ ID NO: 780637 - protein, 140 aa, Homo sapiens
VSLSFVCLLWFSFLLFPICRLSAVGVPLVVDRLQCCSSRCWGRPFPPVGVLAPGPCKLRWRHSLGFSSRASPAFFFGEPTTLYVAPGFSGNRLAQLSLTQSGPGPHESVLKSLPPPPKIFFFFFFFFLEYQRYLLLSQLT

SEQ ID NO: 780638 - protein, 119 aa, Homo sapiens
STKCITCILYFYTLSANLTGPSELPINPLMCHVPLSPLSCHSQTLVLSLHLSLTTLVVSLPSRMFLVKKENLDHQVVMPSSTYTILHQTRVHLLSYFNISLLFHHLLNDNLYIHLNSGS

SEQ ID NO: 780639 - protein, 141 aa, Homo sapiens
SFSPPCVSSLRLTSWILQIFPSAITWECLFLLEQSYLAAEGRERRDGLGLCAVATEILECQAIVVSLKIKFPNKKLQKGRGRGRRRFFSLCKYWFSFSIPIRPKKNILTKRENPFFRRKGNPWKRKRDEQPWFWQAIYFCF

SEQ ID NO: 780640 - protein, 75 aa, Homo sapiens
AHNTLFLTWLNPDKNRAFKLEAPMYFQVGVPCASARIGFSTLESTCFRSPTKIETGSLSVTQAGMQWHHHSSLQP

SEQ ID NO: 780641 - protein, 621 aa, Homo sapiens
MPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEPSLDIES

SEQ ID NO: 780642 - protein, 621 aa, Homo sapiens; identical to SEQ ID NO: 780641

SEQ ID NO: 780643 - protein, 104 aa, Homo sapiens
GRRYNGVCALPCLQGKGTSRSEQIFLLGSEVCRLAPVLPDRNRGPRCNRDSSPTHPGYALRENAKILANPDGPAKPYLFIYFFELRWSGSVAQAGAQWSNLSSL

SEQ ID NO: 780644 - protein, 216 aa, Homo sapiens
MEDSAVPTPDSREAGVWTVPHLNPHSLCLPLPRLAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGKNPPRSPGTSTCHFTAHPQPAVAATCRPGCPGLPV

SEQ ID NO: 780645 - protein, 685 aa, Homo sapiens
GRPWPALGPRAMTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMSEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRFISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 780646 - protein, 226 aa, Homo sapiens
LGTRLGLNGRGESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 780647 - protein, 685 aa, Homo sapiens; identical to SEQ ID NO: 780645

SEQ ID NO: 780648 - protein, 186 aa, Homo sapiens
MEDSAVPTPDSREAGVWTVPHLNPHSLCLPLPRLAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 780649 - protein, 679 aa, Homo sapiens
GRPWPALGPRAMTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMSEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRFISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 780650 - protein, 685 aa, Homo sapiens; identical to SEQ ID NO: 780645

SEQ ID NO: 780651 - protein, 679 aa, Homo sapiens; identical to SEQ ID NO: 780649

SEQ ID NO: 780652 - protein, 717 aa, Homo sapiens
GRPWPALGPRAMTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMSEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRFISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGSPLSNFFDVIKQLFSDEKNGQAAQAPSTPAKRSAHGPLGDSAA

SEQ ID NO: 780653 - protein, 152 aa, Homo sapiens
DIFALGLTIAVAAGAESLPTNGAAWHHIRKGNFPDVPQELSESFSSLLKNMIQPDAEQRPSAAALARNTVLRPSLGKTEELQQQLNLEKFKTATLERELREAQQAQSPQGYTHHGDTGVSGTHTGSRSTKRLVGGKSARSSSFTSGEREPLH

SEQ ID NO: 780654 - protein, 30 aa, Homo sapiens
GVAPYKAMPLGGQKPVVWLGEVAHAYNPST

SEQ ID NO: 780655 - protein, 361 aa, Homo sapiens
KETGGRVDLIFLVPQNPFSEVCLPWRSKMAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTSHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILV

SEQ ID NO: 780656 - protein, 128 aa, Homo sapiens
TRPGLSRENGAVHDCPGQQVRSRPGPASGYWLPWLWLWWLAAWKAVEPACCVKDSAMVTPGQIFMERWSWKGLRHLLDQHTHLGMRKLLPEGELPEVTALGKKVGWAPIEIPRKWDWNRSTFSIMAIR

SEQ ID NO: 780657 - protein, 36 aa, Homo sapiens
MSLSTILLLPRANGWFSGFLIGHRSNDWSSLECLRS

SEQ ID NO: 780658 - protein, 204 aa, Homo sapiens
QAVRSGWGSGPGGMSEVEAAAVATAVPAATVPATAAGVVAVVVPVPAGEPQKGGGAGGGGGAASGPAAGTPSAPGSRTPGNPATAVSGTPAPPARSQADKPVLDNPSPWARVQNGFNGPGMGYGFINQENDTKEKDVFCFTMSRLFKKENQTPRKVLLGDRRFGTNWGRAGGNLECRGKGRKKGAAKEGPTKNVTWGLGGKVPR

SEQ ID NO: 780659 - protein, 410 aa, Homo sapiens
PLASAPGPLPACGRGSGREDRAGRWVREPGGGAGAVAAVAGTGPGGMSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 780660 - protein, 242 aa, Homo sapiens
MTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 780661 - protein, 289 aa, Homo sapiens
GSGPRIFGKADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 780662 - protein, 410 aa, Homo sapiens; identical to SEQ ID NO: 780659

SEQ ID NO: 780663 - protein, 199 aa, Homo sapiens
PLASAPGPLPACGRGSGREDRAGRWVREPGGGAGAVAAVAGTGPGGMSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEK

SEQ ID NO: 780664 - protein, 203 aa, Homo sapiens
PLASAPGPLPACGRGSGREDRAGRWVREPGGGAGAVAAVAGTGPGGMSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRYPRNPGRGWNGCLPSWPVGLDTRPTSSTPAEAHGCNVQLMLVESL

SEQ ID NO: 780665 - protein, 199 aa, Homo sapiens
PLASAPGPLPACGRGSGREDRAGRWVREPGGGAGAVAAVAGTGPGGMSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQEALRQFSEGEGPWVQWFSKRGPCTSGSSIT

SEQ ID NO: 780666 - protein, 300 aa, Homo sapiens
GKPKAAWPAGPERYLGWELRTKVDSPAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 780667 - protein, 257 aa, Homo sapiens
MLENHCLVERALTGTETAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 780668 - protein, 216 aa, Homo sapiens
PLASAPGPLPACGRGSGREDRAGRWVREPGGGAGAVAAVAGTGPGGMSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKAFPPQATPAAYHRRWGW

SEQ ID NO: 780669 - protein, 111 aa, Homo sapiens
GRQCSWAGSLAPGGGVGQLGEPWGGSIPWSPQSLVPCLRPFRPRPRQQPTTEGGDGETKPSQGPADGSRPEPQRPRNRPYFQRRRQQAPGPQQAPGPRQPAAPEVRTSDVG

SEQ ID NO: 780670 - protein, 473 aa, Homo sapiens
MFRGAWMWPGKDAAALTICCCCCCWAPRPSDKPCADSERAQRWRLSLASLLFFTVLLADHLWLCAGARPRARELSSAMRPPWGAGRERQPVPPRAVLPVPPPPPGEPSAPPGTCGPRYSNLTKAAPAAGSRPVCGGVPEPTGLDAACTKLQSLQRLFEPTTPAPPLRPPDSPSRAPAEFPSAKKNLLKGHFRNFTLSFCDTYTVWDLLLGMDRPDSLDCSLDTLMGDLLAVVASPGSGAWEACSNCIEAYQRLDRHAQEKYDEFDLVLHKYLQAEEYSIRSCTKGCKAVYKAWLCSEYFSVTQQECQRWVPCKQYCLEVQTRCPFILPDNEEMVYGGLPGFICTGLLDTSPKRLETKCCDVQWVSCEAKKKKKFKESEAPKTHQQQFHHSYFHHYHQQYHHYHPHHDPPGRVSNKPALLPVSGGSRLSPSRIRLCVLVLMLLHTVVSFSSNQGGGGLGLETLPALEEGLTREE

SEQ ID NO: 780671 - protein, 473 aa, Homo sapiens; identical to SEQ ID NO: 780670

SEQ ID NO: 780672 - protein, 64 aa, Homo sapiens
NCLLSLCSDRILQDVPFNRFEAAKLVMQWLCNHEDQNMQRMAVAIISILAAKLSTEQTAQLGTE

SEQ ID NO: 780673 - protein, 102 aa, Homo sapiens
TEWAGEPSCSFGVHSAPAITQLRNMDEYTSRQVNTEWGAKEGRNSSEFHKHQAQIRAQRKKKEGLPLVCLCKLLQSNFTLCYLGSRNKCYLKVLLPSNLCHT

SEQ ID NO: 780674 - protein, 78 aa, Homo sapiens
ERGIHREARQPGVSRPLRDVELRQMSPKPRASGPPAKAKETGKRKSSPSARAAAGGASERGDPARPPESGERAGGTTE

SEQ ID NO: 780675 - protein, 144 aa, Homo sapiens
PSPLSSQEASPVLTWHNPPTRPPPLLRTRPCSQPPPSSSLNQSPSVISLLSFQTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 780676 - protein, 149 aa, Homo sapiens
ERGIHREARQPGVSRPLRDVELRQMSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 780677 - protein, 126 aa, Homo sapiens
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 780678 - protein, 126 aa, Homo sapiens; identical to SEQ ID NO: 780677

SEQ ID NO: 780679 - protein, 126 aa, Homo sapiens; identical to SEQ ID NO: 780677

SEQ ID NO: 780680 - protein, 166 aa, Homo sapiens
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSKKRKRRFTESIKKAHGFRKLKIWLKLRVSNQSPDDIYIARD

SEQ ID NO: 780681 - protein, 126 aa, Homo sapiens; identical to SEQ ID NO: 780677

SEQ ID NO: 780682 - protein, 126 aa, Homo sapiens; identical to SEQ ID NO: 780677

SEQ ID NO: 780683 - protein, 75 aa, Homo sapiens
PKGWWTEKWINTLWSIHTVEYYSAMKRKGILTQATVRRHLEDLRLSERSQTQRDKCRVIPLLGSPWSHQIHRDRK

SEQ ID NO: 780684 - protein, 109 aa, Homo sapiens
KKGNEVWATYRSENKLCDVPAPAQALVVSSQLWAQWYHVGGQFRSIYITKSTSAANQGFSILECWLINNSLNIYQNTIKQFSDHKVIIHSGTSSSLKWDNVILQTGREC

SEQ ID NO: 780685 - protein, 319 aa, Homo sapiens
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 780686 - protein, 301 aa, Homo sapiens
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 780687 - protein, 319 aa, Homo sapiens; identical to SEQ ID NO: 780685

SEQ ID NO: 780688 - protein, 116 aa, Homo sapiens
VSVYPSENWEAWKTPAALACQETVSSPAEAGELHLVTTRGYNSASCPAGLADSPSQQATCSLTQPGCTLFTDEKPEPEGSQGCLHRSETFPNQTAPNPPSGGTVCLLERVVPTTPE

SEQ ID NO: 780689 - protein, 123 aa, Homo sapiens
MGSAHSGFRPGGAPLDAACPPGPEDMQLWTCIAQSPQLLDESRNVPGCPSSEPSNSKSRGRPKNLDFIQLRGGNGEPDARENLHLEEQQKLGAHRALCAMRAPPEGHPMHQEMPGRRALSSHY

SEQ ID NO: 780690 - protein, 186 aa, Homo sapiens
MSGELSGCHTLGCSWHLLGRGHGCCPTPHSAQDSPPMAKNYPTPSANGSEAEEPYPSLLFFNPFMLCVPLLVQEPQLLLSSWGYVSHCAQIFFFALWLLCRARALHPPRFPEYGALTGVSHQVGPTKEFGCPRGEQPHWVAPGRNRGPEVSLEPSLLGSYQRWHAPTPSPRPVPTIRTNWWPVKTV

SEQ ID NO: 780691 - protein, 49 aa, Homo sapiens
GQAAPPWVLFRVPRLGLLFQEKSGPNLEMQLCYLHSSPRIHTGLLMSAG

SEQ ID NO: 780692 - protein, 157 aa, Homo sapiens [sequence omitted]

SEQ ID NO: 780693 - protein, 49 aa, Homo sapiens
SSPKIHLGRKRPGKECLEGKHEQVSSGVLLTAWPTVGQRAEWGGCGKAR

SEQ ID NO: 780694 - protein, 87 aa, Homo sapiens
SDTDRSEGLSPWPRSPGNSPLGDEFPGMFTYDYDTALQSKAAEWHCSLRDLEFSNVDVLQQTPPCSAEVPSDPDKAAFHERDSDILK

SEQ ID NO: 780695 - protein, 82 aa, Homo sapiens
KDRNDLLSGIDEFLDQVTVLPPGEWDPSIRIEPPKSVPSQEKRKIPVFHNGSTPTLGETPKEAAHHAGPELQRTGRWVQILI

SEQ ID NO: 780696 - protein, 92 aa, Homo sapiens
GPACCTAQLPVVWQWAPSGLSGAAGAPAACGCWTLEAWLGRTRARLLNFTGFVISVEPHMVGGFHLGPGLCRGGQVWVAGSPGREVTVSSGE

SEQ ID NO: 780697 - protein, 103 aa, Homo sapiens
PHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 780698 - protein, 105 aa, Homo sapiens
SWITSLRTQECSLRKAQGLTMCTQPLWSAFQTAPCCLILSLIHSTMGLPAASLLQGLKCNPWAPTLRPLNLVPSARNPLPQHGHWASPHFIQVSVPVSFSRPVLA

SEQ ID NO: 780699 - protein, 74 aa, Homo sapiens
QACPIPKRILALGLSLAQSGRKAGLSNRPTCLHTLPPRSTQGLQNQLRPPLRAESLFRYREPALKASSDTENQH

SEQ ID NO: 780700 - protein, 118 aa, Homo sapiens [sequence omitted]

SEQ ID NO: 780701 - protein, 72 aa, Homo sapiens
MGRDVLDGNMVLEVPYLHPAAPPPTTLECKIASLLTLTLFPGPTPRQVQDSPWCSLRVQTSEALAIPVLAAP

SEQ ID NO: 780702 - protein, 105 aa, Homo sapiens [sequence omitted]

SEQ ID NO: 780703 - protein, 165 aa, Homo sapiens [sequence omitted]

SEQ ID NO: 780704 - protein, 107 aa, Homo sapiens
SHPKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 780705 - protein, 107 aa, Homo sapiens; identical to SEQ ID NO: 780704

SEQ ID NO: 780706 - protein, 107 aa, Homo sapiens; identical to SEQ ID NO: 780704

SEQ ID NO: 780707 - protein, 72 aa, Homo sapiens; identical to SEQ ID NO: 780701

SEQ ID NO: 780708 - protein, 123 aa, Homo sapiens
MVTDPEAFTCSCLSGSSPLPHGGALPMNELMLREVKRLPGQGAGNQEGKDLTQVILMPNHEHPTTVSADGLRMRHDFFPGHCSFVTVMGPFSALTLALAQHRGRQDSREERVALMAMQGGEWA

SEQ ID NO: 780709 - protein, 94 aa, Homo sapiens
GLEEQQVSLSGPSSILSAASPGAKLPRVSLSRPSSSCLPVASFSPAQPSSWLSAAFPGPAFDFWRPLQAQNLPSSGPLQARPRPRPHSGLSTPS

SEQ ID NO: 780710 - protein, 245 aa, Homo sapiens
GKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPI

SEQ ID NO: 780711 - protein, 59 aa, Homo sapiens
LRDSLREAPAQVGNKTNIVSLSLETDWGLNFALTIASCVSWDELFNLHKLQSLNTLDTN

SEQ ID NO: 780712 - protein, 160 aa, Homo sapiens
RGGRGGMEVAAAATRPGRTESPAIPSRPGMGNGVKEGPVRLHEDAEAVLSSSVIIKVSSKRFSAKEAFRVLYYTYLNEGFLSLWRGNSATMVRVVPYAAIQFSAHEEYKRILGSYYGFRGEALPPWPRLFAGALAGTTAASLTYPLDLVRARMAVTPKEM

SEQ ID NO: 780713 - protein, 127 aa, Homo sapiens
MAVTPKEMYSNIFHVFIRISREEGLKTLYHGFMPTVLGVIPYAGLSFFTYETLKSLHRGKGAGSMRRGRSGSIPWGQQLHLGHIDLETRRSGVRPLGGAGCRPTSKSGENTLCAAATEEPGLTALNA

SEQ ID NO: 780714 - protein, 111 aa, Homo sapiens
MASAARACRAELRTESPAIPSRPGMGNGVKEGPVRLHEDAEAVLSSSVSSKRDHRQVLSSLLSGALAGALAKTAVAPLDRTKIIFQVSSKRFSAKVSHYVTAPAWGQSPLP

SEQ ID NO: 780715 - protein, 259 aa, Homo sapiens [sequence omitted]

SEQ ID NO: 780716 - protein, 273 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPSCIIAFIFIATVIALRKQLCQKLYSSKDTTKRPVTTTKREVNSAI

SEQ ID NO: 780717 - protein, 119 aa, Homo sapiens
MVALLKLLWPPFCCDCVPVRGLQGSARPPFFLSHHTSPNAFSMPGPLAPHSSLPMWPLPPPNALIHKSGLSRETEQTGCMWREERGEQGERRKESREREDRKVGEMRGEERERGGRDRC

SEQ ID NO: 780718 - protein, 44 aa, Homo sapiens
MVGRCCGREHDSHLHIDKELYHCSKNAHTVCILATLESSSQPLM

SEQ ID NO: 780719 - protein, 75 aa, Homo sapiens
GVQRSLSVRRAVLINSHLEKDHSGKNTENEQLRAGVMACNPSTWEAERVDHLGQKFETNILLTTYKINSPVPQKQ

SEQ ID NO: 780720 - protein, 104 aa, Homo sapiens
MELTGSPTCERWLVHWPWPPRAMTLIHWLHPPPCSMALGVTCSCPLPSVWILPMRTPSRRWGLSYLTERLSSTQRFCLQPTQHDEIKTRGCSLLRVDHPAHLVT

SEQ ID NO: 780721 - protein, 223 aa, Homo sapiens
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 780722 - protein, 223 aa, Homo sapiens; identical to SEQ ID NO: 780721

SEQ ID NO: 780723 - protein, 291 aa, Homo sapiens
VRLLLGPGAGLRGGVVLKVSPSPCRGGRRVPVRAEGARGRGPRNKVPGASSGAAVGAARLTAPLLAKAMASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 780724 - protein, 84 aa, Homo sapiens
ESKQCPESKQCPESKQCPDPNLCPPSACRATVEAVTRGDSLPVLSFPRITPLLPSSSQTQMSSIVTLGVPISLVGKEKGKNSHQ

SEQ ID NO: 780725 - protein, 291 aa, Homo sapiens; identical to SEQ ID NO: 780723

SEQ ID NO: 780726 - protein, 291 aa, Homo sapiens; identical to SEQ ID NO: 780723

SEQ ID NO: 780727 - protein, 223 aa, Homo sapiens; identical to SEQ ID NO: 780721

SEQ ID NO: 780728 - protein, 223 aa, Homo sapiens; identical to SEQ ID NO: 780721

SEQ ID NO: 780729 - protein, 79 aa, Homo sapiens
LFSLIRTNPTQLSLVRNNGEPLPRLGAAMGPASLDLKCSRYPAGSGGVEVSGGVCNNSNQHVVDGERKLSSNQNNTRTT

SEQ ID NO: 780730 - protein, 83 aa, Homo sapiens
RSEYSSYMDKAIRQQLSLVRNNGEPLPRLGAAMGPASLDLKCSRYPAGSGGVEVSGGVCNNSNQHVVDGERKLSSNQNNTRTT

SEQ ID NO: 780731 - protein, 118 aa, Homo sapiens
TQTHEHKHTCTQTHTYTYAHKHKQHMSTTHTSINTDAHTCTNMSTTQTYKHKHTDAHTCTNTHTNNTHTCTHTNTHANTRTQAQNTNTCRNTHTSRNTHAHTCTNIYTQSHTSTHKHM

SEQ ID NO: 780732 - protein, 101 aa, Homo sapiens
KNLNANTNQFKAVVSILISDEAGFRAMMSIHQKNITIPKVYDLNNRVLKYMKQKLIALQGEIGKCTVMLGDCNIHVSINDKTSGQMIGKDIDALGQHNIPT

SEQ ID NO: 780733 - protein, 112 aa, Homo sapiens
FLFPFHIPQLSFLLPPGGHPVLDTRLCPVLWVMLGGIAYQREGGTEVHLLQKSVLPSSRQMPASQSWLTKTLCLMSCPGPSLSLFCPHPDHKHWGSTSVFLAAASGACVSAC

SEQ ID NO: 780734 - protein, 66 aa, Homo sapiens
FCKDISFFRFPGGFFDRLFLPTYFFLLLIIFIIIIFIIFVVVVILVLIISFFFYATFVIYVSITWR

SEQ ID NO: 780735 - protein, 80 aa, Homo sapiens
FPKSAGSCDSGHQLVLLDSISSLGETSLFMATCVEVDMGVRLGEHYSESSKSQNTGQLGHKITTWNPSTQSPGTLPPHEL

SEQ ID NO: 780736 - protein, 103 aa, Homo sapiens
MPINSSPSAVSRYSLYSLYSLSPEPGDAATQLLSSPLQAVYSPNSMLLRPGSGLSVFQLIASPPSGLFEVKYHATAHLVSYLPFSTLTQDFHTCLSPRSPSLS

SEQ ID NO: 780737 - protein, 76 aa, Homo sapiens
SSGLQRSVLHRYSVFRILLSPVCSHPPGVASGYKGAVGKLYGSDAIPCLLLVFTPTWSLGICPRALRIMVEPTKMG

SEQ ID NO: 780738 - protein, 104 aa, Homo sapiens
NSGLESSLARLGLKRPWQILEPQIPSLALYTATNPTCLRFLKIKPVKERKERQALLSNPQPRSVPQSCICWDLKSALCSSVMAHASMGRVSGLLRASLAASLLL

SEQ ID NO: 780739 - protein, 209 aa, Homo sapiens
MAETKDAAQMLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCG

SEQ ID NO: 780740 - protein, 200 aa, Homo sapiens
MLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCG

SEQ ID NO: 780741 - protein, 56 aa, Homo sapiens
GTWPSPGGHSDQHLYVQEAECLSGDGPPAIQDGDTKGCSEIVISERENGGHRGKRY

SEQ ID NO: 780742 - protein, 96 aa, Homo sapiens
PSSGGDRATKTVSYRTTPSGLQIMPLKKSQNGMENGDAGSEKDERHFGNGSHQPGLDLNDHVGEQDMGECDVNHATLAENGLGSALTNGGLNLHSP

SEQ ID NO: 780743 - protein, 179 aa, Homo sapiens
ILYPVTLIMHLLVHSVFCFFCSFLVNALGFSFSPDSPPSSSSFSSALGFSFSSFSSFSSSSSSSSSFFFLLLLLFFVFKLRQGLTLLPRLEYSDAILTHCSLKLLGSSDPPTSASQVARTTGVHHHAWLIFICFVEIGSCYVARAGLELLSSSDLLTSASPHVGITGLSYCAKLNFLHA

SEQ ID NO: 780744 - protein, 106 aa, Homo sapiens
LCLVDTDAEFGYALSLPIFVARVVQRHTAATRSLYSYSWVPVTCTIFVGSFEHLLRLWHHKMLNSSYILPARPYDSAISQGSPGSLCWRIVLETKKPGAGHGGLHL

SEQ ID NO: 780745 - protein, 44 aa, Homo sapiens
MELVWVWVFPIDIQLINCLTMDLVVLIWVQALLLSTHTTVSGMV

SEQ ID NO: 780746 - protein, 99 aa, Homo sapiens
MLSDISKRIPCLMRSKEERMTQKRPRRAHSALSRMLSDMESSDSNSAWRHFYTYGHRHMHTHTPHHHNKTCCTDGSSLTEQSVRMNFEPGTVAHFCNPS

SEQ ID NO: 780747 - protein, 160 aa, Homo sapiens
TQTTCTACTHIRARKYTHVLTAHAHCTCTHGTHTACTHICTVLQACALTAYMYSYCMHRPSLHSDHACTHIHTVHTGMYSEHLHTLYTCSCTHALTTHDTVHTQHTPPHSVHTHHTPPHIHTIHPQCTHTHTIHPHTVYTHTHHTPPQCTHTHIHPHTVY

SEQ ID NO: 780748 - protein, 152 aa, Homo sapiens
MGAAGGIDCWEFAMGKRGKRELGLGMPVGSGLVFRNGSGLWPADNPSLLPWGVREGSSPDLDPPLLPSDHLSTSLFHLLHLISTSALLFSHRIKLASSSLLLKHQSLVSGDVPKAAFPTIFSPCTGVPSQRASKLPIPPPSLFPLSWLIFVP

SEQ ID NO: 780749 - protein, 83 aa, Homo sapiens
TSRRNVMLTWLVVSLYHARLWTGKNPWATIIKKHSITWMEPVKFLEGGSIAWIIGSPVSSLSVSFSLLLPSCGTSDMSPNRSQ

SEQ ID NO: 780750 - protein, 155 aa, Homo sapiens
VCCFDDLLSSCCLPYVWQCAVNLLNPILDCVIARIAIIPHYLRDSAVVRFLRPLGSEVSFVLLVFTDAVCYAWVPAFYFFMGDFHLIALLHRYKATDLQNENSWGTLSGVRVEWRRWWYLLKGVLMVEGSSFFLGRIPFVLSKETSLHHGLWTCL

SEQ ID NO: 780751 - protein, 106 aa, Homo sapiens
SLKISWVRGQLLTCTSANVSSYAWVPAFYFFMGDFHLIALLHRYKATDLQNENSWGTLSGVRVEWRRWWYLLKGVLMVEGSSFFLGRIPFVLSKETSLHHGLWTCL

SEQ ID NO: 780752 - protein, 111 aa, Homo sapiens
MVKPHLYRKIQKLAGCGGTTCSPRYLGGWGGRMLEPRSQTGLKLLASRDLPTLDPKVLGYRCEPPCLASYLFQESFIDYILKYFKYIFLNCDKRYIKVAILSIFKCTVQCH

SEQ ID NO: 780753 - protein, 107 aa, Homo sapiens
RCIGSGSRAGFPDEGTPELRLGGSMLPTDGRESRGPEAGRGLCWTSPVGPVIHSESGGGAGRARPRRTLWDKVRLGSLSQGQGRPLKVSGRGMTCSFLYSKKTTLPL

SEQ ID NO: 780754 - protein, 108 aa, Homo sapiens
LSQQRPTPYINITNLYIHKQSTVSAWFPLILVCPLIFSHQTWVGSQCPTGFLCLVPLGRNEYPLSPSISLGRILPLDPGMVMEASFKTSSTALAYFSQDGVIYSPLGP

SEQ ID NO: 780755 - protein, 96 aa, Homo sapiens
HFPAVTTYAHKNMPLAKDLLHPSPEEEKRKHKKKRLVQSPNSYFMDVKCPGCYKITTVFSHAQMVVLCVGCSTVLCQPTGGKARLTEGCSFRRKQH

SEQ ID NO: 780756 - protein, 72 aa, Homo sapiens
TLCGDELISWRCPPPTPHIPSSPGSDIRQGWNGTSDVSSQPETRAHCLPRGQVAGTAFTLAPRFSVFETVMI

SEQ ID NO: 780757 - protein, 83 aa, Homo sapiens
PGSAIPSMSLSPPSAGAEGKEEDFQFKFDHVVRRRNRQTDARDLVGGLNPERGLTCQKGKGAFVGPSSKGTNPIHGGSTLMTS

SEQ ID NO: 780758 - protein, 161 aa, Homo sapiens
GNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPR

SEQ ID NO: 780759 - protein, 74 aa, Homo sapiens
LSTGGIFLLVTLVTVCACWKPSKRKQKKLEKQNSLEYMDQNDDRLKPEADTLPRSGEQERKNPMALYILKDKVS

SEQ ID NO: 780760 - protein, 114 aa, Homo sapiens [sequence omitted]

SEQ ID NO: 780761 - protein, 106 aa, Homo sapiens
MAVTWGQFFSPQGSLPSLQTAWVVITGRGHHWHLVGGGQGRCSTTFESRMPHWPQVSPGPSLCMLFPQEIITISRDSRVNHPLPFLMVLLHVCVSRSRLALPVFEL

SEQ ID NO: 780762 - protein, 131 aa, Homo sapiens
PQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELREGKQKQTEDPFLMWVRAKIPFSACLQAFS

SEQ ID NO: 780763 - protein, 117 aa, Homo sapiens
CYKQITPVFSASFFGIPTGPISGQFGALPGRNSTATTFGVIPAASPEGQNRCPEVPPMFYDSLGCNGRHNFKNHFRATSLQILMIPFHVCHVCHVAVPATAVILRVKFPQVLSRTFY

SEQ ID NO: 780764 - protein, 210 aa, Homo sapiens
RFLLPTCEERRVCFPFHHDCKINKEGDEHSSVKFLATIISTFVSMILNTLSTSYYSHPNGCHFHARPCEETTKQALCEQQGCLFHLAAEVGRPNRRIMSDRREEMTAVTFSDPVGKTSTYPVKVSTQTKRGLPRRLGKISLQPLSREDLGRSQRALGPQFQGSESGCSLLTVKTMRVKTFMMIHFHFMNRKYVFSLPYDFLKTFSFLLHA

SEQ ID NO: 780765 - protein, 318 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 780766 - protein, 318 aa, Homo sapiens; identical to SEQ ID NO: 780765

SEQ ID NO: 780767 - protein, 172 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQVSVEAKYWCLTRWEERTDDAEDCREAKNYAQVHLKIN

SEQ ID NO: 780768 - protein, 114 aa, Homo sapiens
MVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 780769 - protein, 99 aa, Homo sapiens
ESKQCPESKQCPESKQCPESKQCPESKQCPESKTVPPFKRHRVASWIKKQDPVICCLQETHLICNDTHRLKINGWRNICQANGNQKNARVAILVSDKTF

SEQ ID NO: 780770 - protein, 119 aa, Homo sapiens
QRLCNSVDSTAHGASSPHITQPSHGEPLPQLSHHSGHQTSGLGQEGHCYLLQSGRHILFTSQKDWLISSLTSCVALAKFLNLSGPDLPHLQNGKNTSPTGLPPSANEITSMKELCKSSV

SEQ ID NO: 780771 - protein, 457 aa, Homo sapiens
EWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTNK

SEQ ID NO: 780772 - protein, 132 aa, Homo sapiens
DEVEGLKRLMTEILGRQDGVCKTGSLTMHGNWWRPNFEPPAPRRSSHHLPCCYQVQPTVISCLDSCNYLLIDSPTPTPPPDLLSRQEPTLSSENVLQVIQSSAEHSQMAFCGPLSKSRSHPSQPTQLPSFPL

SEQ ID NO: 780773 - protein, 85 aa, Homo sapiens
VSGEAQGGGTGHQQTCAGAPVYSSGGDGSSSSRPPQDPLHLALAGGHASIRRTLGHAAKRQQDKSGDPGRCSLENRVVGQRLDPT

SEQ ID NO: 780774 - protein, 196 aa, Homo sapiens
QPSWAAQAQIPGPKRKASPQITRRVRGVRGEGLETQEGLPKMRRWPRREVQLQKQALTAGLSSLEPPQRCQAQASLRAGQRHTGPQQTIVMNGSLQGGDCQVPSGRGGSHGRGWSMMDGADLKQEAGQLARKGLGSECRGGEDNRAGEDRNSRWPERKSVGSPAGLACLRQAGGRPMAEHAAVEVGSEAWNGHQED

SEQ ID NO: 780775 - protein, 107 aa, Homo sapiens
GERIIGAWKSRLQWAMIASLHSSLGDRVRPCLKKKVTDNYEHVLAPCVNNQISKGRMRSKSTQIRNFYVILLSKTILSPTDHEEKRLSKPHQILGSTGLVNLVVQKY

SEQ ID NO: 780776 - protein, 173 aa, Homo sapiens
KDLKAEIAFDPDNPINCVYIQKDYKLFCYEDTCILMFIAAPFTIAKTWNQPKCPSMIDWIKKMSCIYTMEYYVAIKRNEFMSFAGHIDEAGNHLCGNHHSQQANTGTENQTPPVLITWELNNENIWAQGGKHNNRGILSNITNKGSLISVWEALLSRIWQGGEHHTPGLMCVF

SEQ ID NO: 780777 - protein, 290 aa, Homo sapiens
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRAAFNNNVSVAYECLSAGGRRKRPGLDGRTYSELLRRICRDGQAPEEVVAPLLRKVQCRDHEAVPLSVFRAGTLTCFVLLEFVARAGALFQLLEDSAAAVADRRVGQAVLDTLEGALQASDAAAPARFLEAGSRLGPDSLALALDRAVGGRRPSAPMTREEFLERAAALFIAKVKPVG

SEQ ID NO: 780778 - protein, 290 aa, Homo sapiens; identical to SEQ ID NO: 780777

SEQ ID NO: 780779 - protein, 171 aa, Homo sapiens
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRAAFNNNVSVAYECLSAGGRRKRPGLDGLFFFFFFFFFFFFFFFFFFFFFFFFFFFFFF

SEQ ID NO: 780780 - protein, 330 aa, Homo sapiens
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRCPRQMPAVDSRHLLSTYCGQGSVLGTRAITKTNFLALEGRAAFNNNVSVAYECLSAGGRRKRPGLDGRTYSELLRRICRDGQAPEEVVAPLLRKVQCRDHEAVPLSVFRAGTLTCFVLLEFVARAGALFQLLEDSAAAVADRRVGQAVLDTLEGALQASDAAAPARFLEAGSRLGPDSLALALDRAVGGRRPSAPMTREEFLERAAALFIAKVKPVG

SEQ ID NO: 780781 - protein, 277 aa, Homo sapiens
GLIGGEKPNQNVITLDGNFVQVKEDEEFSPSLKGQINERKTDDGTTRTERTRHGEPNRTDGRTTTGHDNRNPNGRHDTTQTKTKRTDDRDGKNDDNRTRQQRTTSDEDKNRKDRPRHGRTDDTEKDRRRDTEAHGQNEQLTKNARQDGDEGQDRHGTNGHDGRRTKKTAKGGEDERNEPNARRRKQRTDTTRQQRTRRKKKSQKEESNLRKKNGRTDRHETPHDNTDTDTEGARGNGAHDRRKNESAKATASGAPTYRTENKRARNDEKRKQDRKKN

SEQ ID NO: 780782 - protein, 136 aa, Homo sapiens
MRHEELNSLRTLLAAFLLSICPLPPSFLTSVNSIPGRPVPQPASGRGMSSTQAEPLGALCTPVTVTGSEFNTWLEPDRRRVNPRLAKTKMLSFLMGVNQPVYITLGAAGRACVSHEADSPQVGQRNKPQMTLWRSW

SEQ ID NO: 780783 - protein, 110 aa, Homo sapiens
ADAGRAGKEAGAGRAALPRGLVQSQQDLLLGAPGRGHGGQGATSLCPAWLCTTVWLPLCVFTWPSCPSPLQKQHGGKGAADSDLRSVGLLGAGSTARDSLRQHRHLLWFL

SEQ ID NO: 780784 - protein, 157 aa, Homo sapiens
QRLREAAEGLRVATNAAAQNAIKKKIVNRLEVAAKQAAAAATQTIAASQNAAVSNKNPAAQQQLVQSCKAVADHIPQLVQGVRGSQAQAEDLSAQLALIISSQNFLQPGSKMVSSAKAAVPTVSDQAAAMQLSQCAKNLATSLAELRTASQKASGAC

SEQ ID NO: 780785 - protein, 103 aa, Homo sapiens
GFPNAAPAPTDGSTQGSHWHLSSWADPDYSNGHVNPQYPHSVGLRKELLPKSEELVVWYILLPFSWPWRALGITSSHQHYPLFKFSSCLISAYPVLVQAKEMP

SEQ ID NO: 780786 - protein, 219 aa, Homo sapiens
EAKSPARHRRRVGQPAPVEGRAEGTGRREQAAQHQHVLVPGGHCVSKLRGKLKQDVGPEWEEENVQAVPFSWAGVIFPVGRLMRYLKKGTFKYRISVGAPVYMAAVIEYLAAGNSRIGGNAARDNKKARIAPRHILLAVANDEELNQLLKGVTIASGGVCPEFTPTAGKKRGTKGKSETILSPPPEKRGRKATSGKKGGKKSKAAKPRTSKKVQTKGQR

SEQ ID NO: 780787 - protein, 178 aa, Homo sapiens
MSSDISEVEDKNEFLTEQLSKTEIKFNTLNDKFRKKRDDSQKKVIGFRNSPSDLSQTQQQIKEMKEMYENAEAKVNNSTGKWSCVEERICQLQHENPCIEQQLDDVHQKEDHKEIVTNIQRGFIESEKKDLMLEEKNKKLMNECDHLKESLFQYEREKAEKVVSIKEDKYFQTFRKKI

SEQ ID NO: 780788 - protein, 122 aa, Homo sapiens
NIERSFVYFAQFPPMVTFYKLTRYHNHDVCSLVWVCVLSSGQFNHLGGFSHHQSIHYTVPTPQGSLVLPPLSATLTRKLWQPLQHPPFLKFCHFKIIHNISKMEPYSMNLFGIGFLHSAYRL

SEQ ID NO: 780789 - protein, 62 aa, Homo sapiens
PHIEGRAANKMVGPCLLELTFWGGETGSKSIYTRQKVRWRYQGEAVVHDGGVLLDQVVEQRP

SEQ ID NO: 780790 - protein, 144 aa, Homo sapiens
GTWRLDSTVLFQVPATLHAQGSRSRRLCSLPLQLHSWASGTECEPPLPSFPFFPSPQHAGITACCALGLQYPLLSLSHPTSTLTEMAKSSSAATLFMKLLSFTALKKIASFLWILKDFTSFSCKVLTFYCGLLLDVSTVSFSPA

SEQ ID NO: 780791 - protein, 230 aa, Homo sapiens
RFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVL

SEQ ID NO: 780792 - protein, 117 aa, Homo sapiens
ASKEADVWSVCHLPLQEWGLAVIQRLTVMTCSQGSRSYVPRVFREACECEMFGLSRAFFLSRLQRAGQQVIWFFSVICFPPQDSSPLSPPLLVLRQMDTEIHSLFYPSSLLTPVGSL

SEQ ID NO: 780793 - protein, 71 aa, Homo sapiens
MVRYRVYGCFPHFEPKTLEILGSRLEGWSRTANTHVGTRLTGIETDGGHEIRKGRSGKWHGDTGSPSGVSL

SEQ ID NO: 780794 - protein, 36 aa, Homo sapiens
NQATEGLLSSSKSETDSGRDGMRSQAFWLRALVFVA

SEQ ID NO: 780795 - protein, 405 aa, Homo sapiens
MDSLVTANTKFCFDLFQEIGKDDRHKNIFFSPLSLSAALGMVRLGARSDSAHQIDEVLHFNEFSQNESKEPDPCLKSNKQKAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 780796 - protein, 425 aa, Homo sapiens
MDSLVTANTKFCFDLFQEIGKDDRHKNIFFSPLSLSAALGMVRLGARSDSAHQIDEVLHFNEFSQNESKEPDPCLKSNKQKVLADSSLEGQKKTTEPLDQQAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 780797 - protein, 81 aa, Homo sapiens
KGQKPHDYLHTIKKKVFDKSPHPHTFMVKTFNKLGKESFPNAIKDICEKLLVTIVLNGKRLNVFPPMIRNKTKKSTISTFI

SEQ ID NO: 780798 - protein, 39 aa, Homo sapiens
VPTPSIISITKELVRNAKLAWTSDLWNQNSGGGAHQSVF

SEQ ID NO: 780799 - protein, 562 aa, Homo sapiens
MSYIKSNLELYQQYTAMAPKLLARISKLLMICQNAGISVPKGIRNIFEFTWEELISDPSVPTPSDILGLEVSFGAPLVVLMEPTFVQVPTLKKPLPPPPPAPPRPVLLATTGAAKRSTLSPTMARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRFQAWLDPGPEMIPPDLRISWLCFPLCWLHSQGVSLLLMTR

SEQ ID NO: 780800 - protein, 562 aa, Homo sapiens; identical to SEQ ID NO: 780799

SEQ ID NO: 780801 - protein, 782 aa, Homo sapiens
MARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 780802 - protein, 440 aa, Homo sapiens
MARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRFQAWLDPGPEMIPPDLRISWLCFPLCWLHSQGVSLLLMTR

SEQ ID NO: 780803 - protein, 156 aa, Homo sapiens
MKYGNEIMNKDPVFRISPRSRGTHTNPEEPEEDVQAERVQAANALTTPNLEEEPVITASCLHKEYYETKKVAFQQQRRKQPSEMFRFVLKSEVLGLLGHNGAGKSTSIKMITGCTVPTAGVVVLQGNRASVRQQRDNSLKFLGTALRRTHCVPNLQ

SEQ ID NO: 780804 - protein, 207 aa, Homo sapiens [sequence omitted]

SEQ ID NO: 780805 - protein, 156 aa, Homo sapiens; identical to SEQ ID NO: 780803

SEQ ID NO: 780806 - protein, 156 aa, Homo sapiens; identical to SEQ ID NO: 780803

SEQ ID NO: 780807 - protein, 125 aa, Homo sapiens
LTSDLPTLWEAEAGGSFETSLDNIVRPCSLNCPGRFPQLVLEVCGPMKPIVTVHPERRWLWGSHACCGAAPGDGHPVSPGAGAARVLSNCGGCPVLFASYKPLPDYIFLFNLAARKLKVRLVAHQ

SEQ ID NO: 780808 - protein, 101 aa, Homo sapiens
HQHEVHSSLPSQGCQGKEYGGGSRKGVPTSWPPRRSPWRSFQSTDLTMASLLQHPSLVHRWLQNKVRIPCLAFKVCFPSKTSSPFRTGPVFSPVPGTSMLD

SEQ ID NO: 780809 - protein, 271 aa, Homo sapiens
MVPLQSSLGHRARPCIKRKGLLWKGLQSPGLGCRGRCSSPAFYMCRDVSSHPWRSSPLLCRTRSWAARDWGLGALLVCVCVCVCVCVCVFPGRRPPQSSSCSPGPSGKELEVGWREMWSRAGTSFLGRSLRGTLQGVPRFPRRPRVCCQRGRWGWESVHVFSLGLVSSGSLNLVENEPLCVFPNLQLTRASADPAVAGVGAPRAICWGHLTHHLRSARVAAAGATRPCKYSDAHICSSVSPCGCASDLTRLKRPSEKGPQAGATHCHGTMA

SEQ ID NO: 780810 - protein, 504 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 780811 - protein, 493 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 780812 - protein, 432 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 780813 - protein, 254 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVASLLKPARPRAHREEGTTPDASP

SEQ ID NO: 780814 - protein, 348 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMR

SEQ ID NO: 780815 - protein, 409 aa, Homo sapiens
ASRSPLARCRVAVTTVRSPARWPRARRGGAGRTLLHARGSAGEVGRAGRERERGWRRARRRLGEDGSPQDPELSSLARGGQGAQDRSLAVPPGAQHRSRAATMIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMR

SEQ ID NO: 780816 - protein, 89 aa, Homo sapiens
PLPPPCGAPHNDHCCDASTGAWGSGSCPHSALRCRSRPLRPCWAVHLVPGRCDGWLWPRGPMVQDPVAHEPSATLLRSPRSHVEILSLG

SEQ ID NO: 780817 - protein, 108 aa, Homo sapiens
VLSQEELECVFLGKVIASGTSGMMLITNCGRVPRAWKQSSTWHSSFPSSQVVAQNRPAETLSQLLLLVTGRGEPPGNGGWSFSNFQVPKNDLEHLNKNFHIRGPAPDA

SEQ ID NO: 780818 - protein, 123 aa, Homo sapiens
GSLEPLTPWFKQFSCLSLPSSWDYRHAPPCPDIPFFFFFWIFSRDWISPYQPGWLPGWSQSPDLVICLPWLPKVQLQDLGFLQPPPPGSCTLCLRWAELRWDRLTRRGREATWPEDPVSKIRF

SEQ ID NO: 780819 - protein, 134 aa, Homo sapiens
SPPIAGQKQKGISGIILLLSAKKDRLPRNIHVPELSLKSLFEKYVFIGLYEKMEQVPKLVQWLISIGASVETIGPYPLHALMRLCIQARENHLFRWLMDHKPEWKGRINQKDGDGCTVLHVVAAHSPGYLVKRE

SEQ ID NO: 780820 - protein, 100 aa, Homo sapiens
ARLTPPFPQSCCGSKNEHQCSVVPGRFPAFSPSAQLLCAPSICPQHLPSEDVLEAHQSSQALRGSCIIWLHLAGHPALPIHMNFLFLSLSLLLRTRALAL

SEQ ID NO: 780821 - protein, 141 aa, Homo sapiens
VRTEGKAAGVCFASSVVDYRSSSLHSGSLIISLRPFFKSVPTLPTPVIFLPSGLPPPRIPRIRIFLWNLLQEIWLDSQIKDFQNPILPRIPLLGDPLPESFSPQSPFPSESPFHQNVLPFSFLFPECFPSFSQMANPKCPS

SEQ ID NO: 780822 - protein, 48 aa, Homo sapiens
MITAGLPPAISPPLTDTPESVSTPGLFLSLFAMALGHFRGLGKAGGVE

SEQ ID NO: 780823 - protein, 70 aa, Homo sapiens
VTNTQLKIQDVPISTEGSLLPLLSCCPLTVNQDPDLCHHGLVLPVLELHINGIIQYVRVCGWLLSFNRIL

SEQ ID NO: 780824 - protein, 122 aa, Homo sapiens
HVEVIYVDYFCAVWNLEAEAQKAKIIYSGPQCCLTAEARCLSIIPKCFEHKCCQNPSLPMDPKRYVFICLDDEEEIHSFKNSLSFLFPPFILRCSSCFPYYVPPLCFPFILTCTTSISENTV

SEQ ID NO: 780825 - protein, 67 aa, Homo sapiens
LQHSDGEITLQENSPEAEQCLRQSTRFSLKFPNLISEGISEKQRGFIAGPAMETTMPRLKAQKCGLS

SEQ ID NO: 780826 - protein, 34 aa, Homo sapiens
GSTGKGLGEEPTPAYVTQEGSQWPPQTHLSSSHL

SEQ ID NO: 780827 - protein, 53 aa, Homo sapiens
MAEQGPRFLHGGGAAGTQADETATLARGKLPVRRPGKPGTAAAAIWASHTTLG

SEQ ID NO: 780828 - protein, 384 aa, Homo sapiens
RFQRRCGLFPAPDEGPRENGADPTERAARVPGVEHLPAANGKGGEAPANGLRRAAAPEAYVQKYVVKNYFYYYLFQFSAALGQEVFYITFLPFTHWNIDPYLSRRLIIIWVLVMYIGQVAKDVLKWPRPSSPPVVKLEKRLIAEYGMPSTHAMAATAIAFTLLISTMDRYQYPFVLGLVMAVVFSTLVCLSRLYTGMHTVLDVLGGVLITALLIVLTYPAWTFIDCLDSASPLFPVCVIVVPFFLCYNYPVSDYYSPTRADTTTILAAGAGVTIGFWINHFFQLVSKPAESLPVIQNIPPLTTYMLVLGLTKFAVGIVLILLVRQLVQNLSLQVLYSWFKVVTRNKEARRRLEIEVPYKFVTYTSVGICATTFVPMLHRFLGLP

SEQ ID NO: 780829 - protein, 384 aa, Homo sapiens; identical to SEQ ID NO: 780828

SEQ ID NO: 780830 - protein, 384 aa, Homo sapiens; identical to SEQ ID NO: 780828

SEQ ID NO: 780831 - protein, 293 aa, Homo sapiens
RFQRRCGLFPAPDEGPRENGADPTERAARVPGVEHLPAANGKGGEAPANGLRRAAAPEAYVQKYVVKNYFYYYLFQFSAALGQEVFYITFLPFTHWNIDPYLSRRLIIIWVLVMYIGQVAKDVLKWPRPSSPPVVKLEKRLIAEYGMPSTHAMAATAIAFTLLISTMDRYQYPFVLGLVMAVVFSTLVCLSRLYTGMHTVLDVLGGVLITALLIVLTYPAWTFIDCLDSASPLFPVCVIVVPFFLCYNYPVSDYYSPTRADTTTILAAGAGVTIGFWINHFFQLSYGCLATTR

SEQ ID NO: 780832 - protein, 102 aa, Homo sapiens
ASAAGTAVGCQSSAISSFRYDPSCGSCLAQGHALAETDHIQGLIQEEAQTSGLLCPRWNDSDGPFLPSELPLGSEEALVGPAVWMHFSLCPLLLPSLPFLRG

SEQ ID NO: 780833 - protein, 331 aa, Homo sapiens
SLRNVNWLHALPVMGPELGWGHPRGGDVCSSDSFNEDNTAFAKQVRSERPFFSSNPELDNLMIQAIQVLRFHLLELEKGKMPIDLVIEDRDGGCREDFEDYPASCPSLPDQNNIWIRDHEDSGSVHLGTPGPSSGGLASQSGDNSSDQGVGLDTSVASPSSGGEDEDLDQEPRRNKKRGIFPKVATNIMRAWLFQHLSHPYPSEEQKKQLAQDTGLTILQVNNWFINARRRIVQPMIDQSNRTGQGAAFSPEGQPIGGYTETEPHVAFRAPASVGMSLKLGRRMALSIEADAGETQPPAVTPSLTPGSGSRLVLWLQDPTSKGLSAQRLPP

SEQ ID NO: 780834 - protein, 331 aa, Homo sapiens; identical to SEQ ID NO: 780833

SEQ ID NO: 780835 - protein, 262 aa, Homo sapiens
SLRNVNWLHALPVMGPELGWGHPRGGDVCSSDSFNEDNTAFAKQVWIRDHEDSGSVHLGTPGPSSGGLASQSGDNSSDQGVGLDTSVASPSSGGEDEDLDQEPRRNKKRGIFPKVATNIMRAWLFQHLSHPYPSEEQKKQLAQDTGLTILQVNNWFINARRRIVQPMIDQSNRTGQGAAFSPEGQPIGGYTETEPHVAFRAPASVGMSLKLGRRMALSIEADAGETQPPAVTPSLTPGSGSRLVLWLQDPTSKGLSAQRLPP

SEQ ID NO: 780836 - protein, 262 aa, Homo sapiens; identical to SEQ ID NO: 780835

SEQ ID NO: 780837 - protein, 336 aa, Homo sapiens
TGRQIEDRVALLLSEEVELSSTPPLPASRILKEGWERAGQCPPPPERKQSFLWEGSALTGAWAMEDFYTARLVPPLVPQRPAQGLMQEPVPPLVPPEHSELSERRSPALHGTPTAGCGSRGPSPSASQREHQALQDLVDLAREGLSASPWPGSGGLAGSEGTAGLDVVPGGLPLTGFVVPSQDKHPDRGGRTLVRTGSGPRSLVPAIPLAMCVVGLAHRWPLAPNASAVASQGLCFPEGCHILTSVSRATDPQPPQRPSGGSATRLLPFLSVTPWGTLGLRPQSLPCPGSQECRGTTVSQRGCPIQARSARSSVVGSSPRACSPSPLCGSWAPEHS

SEQ ID NO: 780838 - protein, 124 aa, Homo sapiens
LFLVFFQEVTLPVSSQNLRDKSWLASGASSQALLWLWDPQALEQACSEFFPARVRDPHLTLHCQGPNPRSLSSSPSGPCFSTVGFASAVPSPCSQPSPPVSDFGTPPHLGFQLCDCPHPNSLLS

SEQ ID NO: 780839 - protein, 113 aa, Homo sapiens
GAVPPRPPEFRMAWPVCQGSLSQATETLSACPQNSYRAWASPEADAGQETGQTSMSMGRSGLPARIQEKRCWDNRQPAPESEVKVASSSSCHHPARACPTLQFVPANFHLCVP

SEQ ID NO: 780840 - protein, 145 aa, Homo sapiens
KEPDIGLCRGYAGEPSRHANRAAPVKGLDNWQPLIDTRHAHPRKHPISTYPTPISTLSTQTQHTHQASNLNSSYNTKTHSSTRHPISTSSNTRHTHPPGIQSQLIQHQARSSNLNSSNTRHTHPTSTHPTPGTLIQSQLIQHQAR

SEQ ID NO: 780841 - protein, 105 aa, Homo sapiens
CFSFPLCLGPWADLSQQERLQGFSAGEDASRAPWCAAPLAVLLSPASQKVCGGRQRGHSARGALPFASHPILLFHAGLELWGHIVSLGFFPFQPGVFVRPGKVGP

SEQ ID NO: 780842 - protein, 74 aa, Homo sapiens
RIPSLSLWIGLSWTFHRNGISRCAAFCVWRLSLSVTSSGASSGASALWPAPASLLFLAGGPTAYTCRRLFCCCF

SEQ ID NO: 780843 - protein, 121 aa, Homo sapiens
GRSKGAGRCLRRATRRDKMADKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 780844 - protein, 114 aa, Homo sapiens
CHWSLGAMGLSRGSRGPAPQSASRLRSLRARGACRVQVGRSERGSWVGGGSRRLPGGPSVLSICSSPDPDDQYKLTEDTRQLGLVVCRGTSVVLICPQDGMEAIPNPFIQQQDA

SEQ ID NO: 780845 - protein, 149 aa, Homo sapiens
GEVKGRGAVPAKSHTARQDGGERAAESGAGGRGARAALQVSCALLSPQDKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 780846 - protein, 121 aa, Homo sapiens; identical to SEQ ID NO: 780843

SEQ ID NO: 780847 - protein, 199 aa, Homo sapiens
IVNIKWFPSAIPAQVSRDGRQNQATQGSHDEVWGSLRKPPKSLTPPRNLHTPGGPCKMRVGLIKWSIRGDRIQGEGTGSTLVYWPAGTEEEAQDAKMADKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 780848 - protein, 121 aa, Homo sapiens; identical to SEQ ID NO: 780843

SEQ ID NO: 780849 - protein, 141 aa, Homo sapiens
AAVPRTPPPRSPNPSPERPRSALAAAILATTLTGRTVAIPQPRQRSRSESDVSSVEQDSFIEPYATTSQLRPRPNGRVRWEEDLLLPSFETLDYGDEEDIETQLSSSGKEWGMSVPGRTEEATVMTCTLCHTEIRCHCYMR

SEQ ID NO: 780850 - protein, 207 aa, Homo sapiens
LTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPESGEGLLTSSASHKTKNSWQDGPF

SEQ ID NO: 780851 - protein, 117 aa, Homo sapiens
CTFWLPELHTCRTPGFPVPGATWEPFKNSALKLAISSLKKSVRNDRPGVMALGNRRRPLETKGEALPNLWFPWFLSPLQLQRGRSSNARVAAHLCWRPPGRDAMPALAGAESHCICS

SEQ ID NO: 780852 - protein, 84 aa, Homo sapiens
SPRGIPVNAFIFGCGYLRTQLGEAQDEKCPHCSLDGKILPSLPQEAGSSRRLLSPEASWLEQSHSTDTLPEYPHPAHYNSSGKR

SEQ ID NO: 780853 - protein, 70 aa, Homo sapiens
PFDPKFITYPFDQNRFVQYKATSLEKQHKHDLLTEPDLGVTIDLINPDTYRIDPNVLLDPADEKLLEEEL

SEQ ID NO: 780854 - protein, 76 aa, Homo sapiens
GGRGSHQALTESQGVKMAASRRPHRTLRKQRRETAQKVHWAGEGRGTAAEVCWPRHPVKSARNGFPEVDKDRSLWI

SEQ ID NO: 780855 - protein, 38 aa, Homo sapiens
MLRITYPFASCCSPSNVHFGLCFHTLFKHGLADESARR

SEQ ID NO: 780856 - protein, 91 aa, Homo sapiens
VKMPWAAELRGFWAVGRARPFRRRRSWASFQAGVEAPPRARLASGAFSLDLGPARLPRRGPKERLPCWTASTSSLALPLSKEAFKALGLQV

SEQ ID NO: 780857 - protein, 117 aa, Homo sapiens
QSVRLSSLLCLPGLLVVFAPVVLGLKAITLAALLLALATYSEEPWARRCQDHRPSRSHEHLSMEQGSRVRGQPQSEDPLSWRGARAPQPFPYLQSQPLGAPRPHDKLLDPYIWFWST

SEQ ID NO: 780858 - protein, 58 aa, Homo sapiens
MAEGEFGEIQRVREPEGDHMESMKRTVGLKAGPWQITSRETGALSLQLHELNSANGLS

SEQ ID NO: 780859 - protein, 395 aa, Homo sapiens
VKIIDKISTFSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRRTGTEEGKYRNTINMSTDCENLAKEIPHTKTQQERHNRATHATIEDDCGTEKMDELKPNVRHIQTTRTRRTELMKAKTKHGKNTEIQKSQNTPRERHQHRQGKQRPDNDSRDNRKQIEPPGTLEYRETHRREPQHKHTRANEQEQLHNQIEERHYHTSSDKYPHRDLKREEKPERCDCKCKPQHNKADTDERRTHASCKLSCVRASRRTYNRKTHA

SEQ ID NO: 780860 - protein, 79 aa, Homo sapiens
MAGDPCLSAHIEEGDNKLTGSNRLIGVGFVDSGIPETAASLETPNISCQILHRIFSSPGWKHKPGYQHSDSQVGESAKH

SEQ ID NO: 780861 - protein, 112 aa, Homo sapiens
MLAIRLIKRFCVVSEWGSQASGGSPGHSSSRAGPSELPGCSRQGLEEVRRSRAVSVPGSPFPEQRPWVGSGNWGHQEGPGEWGCWEWPGGGHEVGQGWSWVFWAGLCSPLAF

SEQ ID NO: 780862 - protein, 45 aa, Homo sapiens
MVGRKVCRNSNSTGIHNFPLVRAGLNAPSIGTSPTGPVGFSPRVW

SEQ ID NO: 780863 - protein, 153 aa, Homo sapiens
EICCACPRKHPMCSEWPRRDLSHSLAPGPGRKQPSLKNSDKERLIKTRQEKQQWVSEQPDWQELPPTPEAEGQGWAMVAPEPIRTWTLEGAGRPWARQALRSAARKSLCGVAWVVGTEPGGCLSHRQPWPSAMGGAGTSVIGWRKCYQLLRSI

SEQ ID NO: 780864 - protein, 70 aa, Homo sapiens
GTSAPSPVCSEPPKASSPAPSPTSATAVTCAHGALGPALCLLITGLRVFCCGKKGKEGEEGRETGNHHKV

SEQ ID NO: 780865 - protein, 105 aa, Homo sapiens
MRQKEKRVKREDSGWEERGGGRSTEGEERKQPENLLEGREEREEPDRESRSEKKEGGHREDSEKKRTGIVCSPCRNSLSLSLRQLMLLQMLTDARTAMSQTSPTA

SEQ ID NO: 780866 - protein, 115 aa, Homo sapiens [sequence omitted]

SEQ ID NO: 780867 - protein, 1085 aa, Homo sapiens
LFFIVVMDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCSFKLDKAAHETQFGRSDQHGSKASSSLQPPAKAQGRDRAKTGVTEPMNHDQFHLVPNHIVVSAEGNISKKTECLGRALKFDKVGLVQYQSTSEEKASRREPLKASQCSPGPEGHRKTSSRSDHGTESKLSSILADSHLEMTCNNSFQDKSLRNSPKNEVLHTDIMKGSGEPQPDLQLTKSLETTFKNILELKKAGRQPQSDPTVSGSVELDFPNFSPMASQENCLEKFIPDHSEGVVETDSILEAAVNSILEC

SEQ ID NO: 780868 - protein, 1085 aa, Homo sapiens; identical to SEQ ID NO: 780867

SEQ ID NO: 780869 - protein, 825 aa, Homo sapiens
TVERDTMTLPAYTVHHPLTPPTHNLTHSELNGPPPSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCSFKLDKAAHETQFGRSDQHGSKASSSLQPPAKAQGRDRAKTGVTEPMNHDQFHLVPNHIVVSAEGNISKKTECLGRALKFDKVGLVQYQSTSEEKASRREPLKASQCSPGPEGHRKTSSRSDHGTESKLSSILADSHLEMTCNNSFQDKSLRNSPKNEVLHTDIMKGSGEPQPDLQLTKSLETTFKNILELKKAGRQPQSDPTVSGSVELDFPNFSPMASQENCLEKFIPDHSEGVVETDSILEAAVNSILEC

SEQ ID NO: 780870 - protein, 625 aa, Homo sapiens
LFFIVVMDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQVMPFPK

SEQ ID NO: 780871 - protein, 87 aa, Homo sapiens
VGNFHGWAAAWLEESAEMEARSQPRRGGPPIVHWDFPGYILRGRVARSGAALLQNHNSGSNYSDCPGPGNLRPWIWLKVVPDWYDPN

SEQ ID NO: 780872 - protein, 66 aa, Homo sapiens
GDSRGPPPTSPTGRKLLLSAAKQWPWSLSLWSSPSIPNGQDKRAAWNGWRSQMPYLKSLVSELSTS

SEQ ID NO: 780873 - protein, 86 aa, Homo sapiens
KHAAVAELSPGTECRTKASPTYALKPRQWTLDRRKLLLSAAKQWPWSLSLWSSPSIPNGQDKRAAWNGWRSQMPYLKSLVSELSTS

SEQ ID NO: 780874 - protein, 240 aa, Homo sapiens
GCRIRHEKHMETFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVMFNGCFKLSELYY

SEQ ID NO: 780875 - protein, 279 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRKSGTPNGGTGRSHGRRTWIVKIS

SEQ ID NO: 780876 - protein, 178 aa, Homo sapiens
METFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 780877 - protein, 256 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFR

SEQ ID NO: 780878 - protein, 228 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 780879 - protein, 295 aa, Homo sapiens
LMQWIGLLHTGWASGRLDSSAGGEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 780880 - protein, 295 aa, Homo sapiens; identical to SEQ ID NO: 780879

SEQ ID NO: 780881 - protein, 202 aa, Homo sapiens
LMQWIGLLHTGWASGRLDSSAGGEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGEIAIITDSYKINDN

SEQ ID NO: 780882 - protein, 116 aa, Homo sapiens
MATDTTVRPVTSSLPDTHISTVPGTQPLTIHIHNSNYAATHTPCHVSSVYTTTNASYTVTKSSHTHIYATYTHTPPIPPQQHSQGHIQLHTHNALHLRSQWEEIQETVTISIDQYF

SEQ ID NO: 780883 - protein, 136 aa, Homo sapiens
MARMKVWLQTPLHTEPQTRPSPQPHRHAQPSWPQIRLCALSHPASLTPTYPQSQAHSHSQYTYTIPIMQPRIHRAMCLLFIPPQMHHTQSQNHHTHTYTQHTHIMPLVNPNATGQPHNATVSTLQCHWSPLIGYDA

SEQ ID NO: 780884 - protein, 39 aa, Homo sapiens
MNLEGLEMVAVLVVLALFVKVLEQFGLFEPVSLEGNPGV

SEQ ID NO: 780885 - protein, 83 aa, Homo sapiens
MRQSQKVHVRRGFINPQSIPGSHWTQDKEETKGRAAPAAPPAPTWEWGHPSTTQQRWRDLLQGFCIRGDPHGSVVTMVTKGPQ

SEQ ID NO: 780886 - protein, 140 aa, Homo sapiens
EHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 780887 - protein, 220 aa, Homo sapiens
MKLSVNEAQLGFYLGSLSHLSACPGIDPRSSEDQPESLKTGQMMDESDEDFKELCASFFQRVKKHGIKEVSGERKTQKAASNGTQIRSKLKRTKQTATKTKTLQGPAEKKPPSGSQAPRTKKQRVTKWQASEPAHSVNGEGGVLASAPDPPVLRETAQNTQTGNQQEPSPNLSREKTRENVPNSDSQPPPSCLTTAVPSPSKPRTAQLVLQRMQQFKRAD

SEQ ID NO: 780888 - protein, 190 aa, Homo sapiens
FVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGSLLCCPGGNAGA

SEQ ID NO: 780889 - protein, 458 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 780890 - protein, 69 aa, Homo sapiens
VTRLRGVSVREVRRLQLQFFFEKYPLFTFVNGHSRDYDFTSTTTNEEDLFSEDEKKQLKRFSTEEFVLL

SEQ ID NO: 780891 - protein, 458 aa, Homo sapiens; identical to SEQ ID NO: 780889

SEQ ID NO: 780892 - protein, 458 aa, Homo sapiens; identical to SEQ ID NO: 780889

SEQ ID NO: 780893 - protein, 366 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLEVIL

SEQ ID NO: 780894 - protein, 458 aa, Homo sapiens; identical to SEQ ID NO: 780889

SEQ ID NO: 780895 - protein, 458 aa, Homo sapiens; identical to SEQ ID NO: 780889

SEQ ID NO: 780896 - protein, 139 aa, Homo sapiens
GVLKVPVAAALRSERLRVCGLVLWRLLLELEHLPDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 780897 - protein, 88 aa, Homo sapiens
MAAGGARLDPAEDLQPTMWLSLGRGSRVSRAYTCQGQGLVQVSGNRGGAHLRRVCASPAATYQVPGPCSCVQSKAETEYSPRASRNGH

SEQ ID NO: 780898 - protein, 113 aa, Homo sapiens
QVPFFVLTESSASLSCISKWHHHHPAARNKNRGVTPDASPFSSIIFSPSASPRICNLQNIPRVQPFTPSPLPAPEPSHHHLLPDRLSWPPAWSPCSTPVSLSSILHTTARPSI

SEQ ID NO: 780899 - protein, 467 aa, Homo sapiens
AYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVRGDLSTAVLSAQSFLSFLLLSPRSCSH

SEQ ID NO: 780900 - protein, 280 aa, Homo sapiens
AYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLR

SEQ ID NO: 780901 - protein, 70 aa, Homo sapiens
REAEDAQSVRRGLCRAQSGEVCRAQDGGGEHEAGVCAEHEAVGWRARGRVCRTQWLCSVARYQIRSLARS

SEQ ID NO: 780902 - protein, 284 aa, Homo sapiens
RGRGARGGKAEDKEWMPVTKLGRLVKDMKIKSLEEIYLFSLPIKESEIIDFFLGASLKDEVLKIMPVQERQGPCCRASCQPRVSRALCGPHRGALQMGQRPGPGVVKRCFQRMCGGHRTFPVVAQYNPVATKALPIRSPCCLASRAERGGGNNRIRRKAPNKWSPFGNCVDSASCKTLLVGLGYALIPLQTPGGTVGIFGLSDKRCWPKRRLLQLTGLGNPNDVYHPSMPGGCKCATLGNFAKATFDAISKTYSYLTPDLWKETVFTKSPYQEFTDHLVKTHTR

SEQ ID NO: 780903 - protein, 107 aa, Homo sapiens
SHFCTQAHFGTQAHFCTQAHFCTQATSGVHARGVFLLQGRPDGAQAVGALTPGALAVIGAADCTEVTGAFDFYTLPVGLRTVPVTESQWVRASFICGRGSRGCRNAP

SEQ ID NO: 780904 - protein, 66 aa, Homo sapiens
LTFYIPSKKGQLDSLKEKLHRGKLRFNPAPYTPPATCSPTIICRIPGAVCSLISNRATQGSREPNI

SEQ ID NO: 780905 - protein, 132 aa, Homo sapiens
VAEVSNISVIIVFIINIIAKICCMVITWQTLIPYNNLRTEFLFSFLFCRSENYRRGSGKLTCPRYLFHLASEPRFALFQSAAPSHHAEMCSVPTGTVVNMPTHLMQLKFGSCVDLTAYSKHFFPLTFPQYLA

SEQ ID NO: 780906 - protein, 73 aa, Homo sapiens
STAACRAGGGDLAGRNWDSGGALPFGVSAAQVEPSAPLLHRTCWRARQKLTAQRLECSGVIMAHCSLNLPGLR

SEQ ID NO: 780907 - protein, 76 aa, Homo sapiens
VHRCLPRRWGRPGWPELGFGGSIALRRKRCSGRAQRSASPQNVLARASEANRTESFSTLPRLVSNTLAGDPPDSAF

SEQ ID NO: 780908 - protein, 78 aa, Homo sapiens
GGGGGEASRCGYGGLLVLSFPADSPAMVAQASMQFVSQNAQMLFQGTDGPSLYHRSIVVIIITVIKKKNQARLCGSCL

SEQ ID NO: 780909 - protein, 53 aa, Homo sapiens
LVHSYEKPIYLGYLGLCFFNTETNGVWLSHHTAHPSNPLSDEEIQGCSFLEMC

SEQ ID NO: 780910 - protein, 36 aa, Homo sapiens
PIRRWTLGLPCAPSGGGHSVYPEPHQEVDTRFALCP

SEQ ID NO: 780911 - protein, 85 aa, Homo sapiens
ALRTLGGAQNHQGAIRTPEGLQNHQGALRTTRGCSGHDRPSGPPGDFQNTRKHSGHQRAIRTPGGTQILQGALRTTGSSQDTRVS

SEQ ID NO: 780912 - protein, 113 aa, Homo sapiens
MMPLHSSLGDRARLSLKKKGYPGSRRREPVFSCKCAQKLLCVLDDFHLPLQSTLHSHPLMGCISGYLALCHLVGLTKEASTGTGGQAEWKVRISILPVPFLLCCCELAVSIYL

SEQ ID NO: 780913 - protein, 104 aa, Homo sapiens
MVTPDIKSSPQIRGREVECHSGFGQVWKQCTSLLPTSSWPEFSHVPQPIARGWVATSQQQLCRREGGPDLGGQLAASATWTIFVFELLLVSVHLSYLLSISGVC

SEQ ID NO: 780914 - protein, 77 aa, Homo sapiens
MAELGFDCPAFPLALSIICTRAACLPLPSPSWGALGFTRFAAPSCQERLSMCSPTCTHGPSPPEARQSPQSLRGSGR

SEQ ID NO: 780915 - protein, 124 aa, Homo sapiens
MGKRDPRAQLFLPSAGLLQTSRLHCRLRHFLAEPPSFLLSFQLLLLHCPFLSPLSCTSASILASSSLKTQPDTISIITLFISQWRRWGSRQERQSVNMLPLKFCTALSLLGLWAKIKCKSLYYS

SEQ ID NO: 780916 - protein, 68 aa, Homo sapiens
DPRGNPLIDATGVYRRQLVFIDASVVYEMPLHSSLGDRARLHLKKTKKQACMYLAWDCLLKSVNWRCF

SEQ ID NO: 780917 - protein, 350 aa, Homo sapiens
AEPALGSQPQRPAPALRTWQAAAAGQVQGHMAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPEVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 780918 - protein, 89 aa, Homo sapiens
GDLEDPMAGVVNEGPEALVWEAGPPTKAAGPVKDPRLLAFKSSECSCQHTGFKGQLLCSRALLLFPASPVTSGCDCPVPCTLQFRSRLP

SEQ ID NO: 780919 - protein, 583 aa, Homo sapiens
FLVNSKLQLLFEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNGEYSTVGKRKIDQEGRVFQEKWERAYFFVEVQNIPTCLICKQSMSVSKEYNLRRHYQTNHSKHYDQYMERMRDEKLHELKKGLRKYLLGLSDTECPEQKQVFANPSPTQKSPVQPVEDLAGNLWEKLREKIRSFVAYSIAIDEITDINNTTQLAIFIRGVDENFDVSEELLDTVPMTGTKSGNEIFSRVEKSLKKFCINWSKLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLASRNESDGLNYIPKIAELKTEFQKRLSDFKLYESELTLFSSPFST

SEQ ID NO: 780920 - protein, 161 aa, Homo sapiens
MIHLPRLPKVLGLQVGATAPGLTTTKIPKRRIGSSCGLLEGKNGSKSWGSCARTRSPVRAAKAIESGTEWNLSLLKLLRMTPGPGKMILSWSSLHLCISRTDVPPVKGAGSPFVTQAGVQWRDHDSLQASTSQAQVILLNSWDHRNTNSRMAPSLLKTSIN

SEQ ID NO: 780921 - protein, 124 aa, Homo sapiens
PASGKDGRSVRVGFSTESAHVWEGPTESIFNLTTLPWPALMNLVIELGFSSKGLKVPSGFFVLLIVNCKSDKLKEELLNMKEPRPDNFEKSQSLWTAKYARIKKWLLSTFRKTWYRHIATGKTT

SEQ ID NO: 780922 - protein, 118 aa, Homo sapiens
EGQSGKVLPQGGAHVWEGPTESIFNLTTLPWPALMNLVIELGFSSKGLKVPSGFFVLLIVNCKSDKLKEELLNMKEPRPDNFEKSQSLWTAKYARIKKWLLSTFRKTWYRHIATGKTT

SEQ ID NO: 780923 - protein, 122 aa, Homo sapiens
MCLEFLPSGGFVVSLTSRMKPQTVVVIVVALKGGVDPKSEQQQDFSSRGWSLALSPRLECSCPISAHYNLCLPGSSNSPASASQVARTTGAHHHTQLIIVFLLETRLHHGGQDGLNLLTLGS

SEQ ID NO: 780924 - protein, 309 aa, Homo sapiens
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREK

SEQ ID NO: 780925 - protein, 316 aa, Homo sapiens
VSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKICDPDLITADFWYGGGEGGAGWLRALPHPRPLIPLKTRAESAAKQRKRSTWMRIVGPDLKEERDGMRKPQNATQAAESHTGRPPNLTNHQKVCKGDAKNTPKTPPIT

SEQ ID NO: 780926 - protein, 50 aa, Homo sapiens
EVAPPRHSEKSRLQEPVSSTNCTRKKRGREAPRHHRTFKRQAVAQACNPS

SEQ ID NO: 780927 - protein, 81 aa, Homo sapiens
RLNLSESLSVMCCGSHISRTMRAAVKGPPINMYWSQEKKGALGGIWVEEAGTPGSTEIISRVVSILVYTGSQRLGSIYLQR

SEQ ID NO: 780928 - protein, 152 aa, Homo sapiens
MSGFCWKSVPFLRGSPRPRVILGGAQGVTCLLKWKRRMKSTPVRQEHHTVISRKMLHRSASSQSQSPGLGSKLFYLGLTVFWHCRHSSGFCGPLISLRVSLLHVSLSSSLRFLPLALAPSDSFSFSFPSLLSPPFTNSFVCTHSCPSVDPCL

SEQ ID NO: 780929 - protein, 104 aa, Homo sapiens
NKQGSSLGYFIGCHRHYLQIFSHWGLGCNINLGALQHIDHTNQNYGGQVSVFYFKRLKQINIIKEHKQYSHTQREFMIVADNIAVFSMSQALFKRFYGYEYIYV

SEQ ID NO: 780930 - protein, 4147 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780931 - protein, 91 aa, Homo sapiens
YLAIYNYPAIYNYLAIYNYLAIYNYLAIYNYLAIYNYLLESFLKQVSNMVAKNAEMHKNKLQYFMEQFYGIIRNVDSNNYLAIYNYLPGGF

SEQ ID NO: 780932 - protein, 4147 aa, Homo sapiens; identical to SEQ ID NO: 780930

SEQ ID NO: 780933 - protein, 4147 aa, Homo sapiens; identical to SEQ ID NO: 780930

SEQ ID NO: 780934 - protein, 4147 aa, Homo sapiens; identical to SEQ ID NO: 780930

SEQ ID NO: 780935 - protein, 3293 aa, Homo sapiens
DSPELTSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780936 - protein, 3247 aa, Homo sapiens
ELGPDHLSIRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780937 - protein, 4147 aa, Homo sapiens; identical to SEQ ID NO: 780930

SEQ ID NO: 780938 - protein, 1286 aa, Homo sapiens
MVQVPQAKQLVVCVVSQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780939 - protein, 1665 aa, Homo sapiens
MRALHAPPQFNFKVPGGIVGEICNGNTNFPKENKLMLQNEARDPTFGLSAPLDFKLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780940 - protein, 4147 aa, Homo sapiens; identical to SEQ ID NO: 780930

SEQ ID NO: 780941 - protein, 679 aa, Homo sapiens
MLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780942 - protein, 627 aa, Homo sapiens [sequence omitted]

SEQ ID NO: 780943 - protein, 3349 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRVNIKIG

SEQ ID NO: 780944 - protein, 535 aa, Homo sapiens
VLDRDLELVKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780945 - protein, 400 aa, Homo sapiens [sequence omitted]

SEQ ID NO: 780946 - protein, 264 aa, Homo sapiens
PSALTLSGITAAAQLCLFCRRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780947 - protein, 3565 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQGTEEISFVMRLKVSSGYRL

SEQ ID NO: 780948 - protein, 3506 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASGELKIKKLVFHYVSIKSYEFCTYLWSPLCLFSNYKYFENPTVFLRDNGSRVQWIT

SEQ ID NO: 780949 - protein, 2955 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDTKQMMSSFMLSISAVVMSYLQNPAHDAPMVIPAEGSHFGPCLSTRPGLWLLNLLPSAAILDFPEMRPSRCPQLDRG

SEQ ID NO: 780950 - protein, 1099 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALSPPASPPHPNCF

SEQ ID NO: 780951 - protein, 86 aa, Homo sapiens
HFGKGGSKLLRMKLSDFNDITNMLLLKMNKDSKPPGNLKECSPWMSDFKVEFLRNELEIPGELTSRGDKTVLSGAQHCNKNSWFLE

SEQ ID NO: 780952 - protein, 4116 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780953 - protein, 4147 aa, Homo sapiens; identical to SEQ ID NO: 780930

SEQ ID NO: 780954 - protein, 3810 aa, Homo sapiens
MYLQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780955 - protein, 3250 aa, Homo sapiens
MMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780956 - protein, 4147 aa, Homo sapiens; identical to SEQ ID NO: 780930

SEQ ID NO: 780957 - protein, 4129 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQNDELLLGHEKAPAFRDYVAVARGSKDHNIRAQEPESGLSEETQVKCLMDQATDPNILGRTWEGWEPWM

SEQ ID NO: 780958 - protein, 624 aa, Homo sapiens
ILLLVIRRDKQESVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780959 - protein, 569 aa, Homo sapiens
RVRPRVRVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780960 - protein, 400 aa, Homo sapiens [sequence omitted]

SEQ ID NO: 780961 - protein, 137 aa, Homo sapiens
VLEDPYISPTPWMCCQEPSFDCQNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 780962 - protein, 3520 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEVGVFILLGGKELYRT

SEQ ID NO: 780963 - protein, 3360 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIARCR

SEQ ID NO: 780964 - protein, 1488 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQRWVLGSQSGTCCPGISGPSMLPCSCSCSCFLREGLYQWDVCCQ

SEQ ID NO: 780965 - protein, 828 aa, Homo sapiens
GAFPGPGRAGARAGAGLGGMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSGNV

SEQ ID NO: 780966 - protein, 96 aa, Homo sapiens
VGLTGKPLSVVPGKDVCGRCLPRKSLEISLQGWSAGKLPPPPPLPEVNRPQGDAPMGASHQNPSAPVSLQRPLLAKLDMASAGKGETLLSSQAEQC

SEQ ID NO: 780967 - protein, 76 aa, Homo sapiens
TSPVHPRTGRNVRRRLLLPCFSLLLVRSLNTLGAVPQLSFREPLAHFCTVTVTPLWAHRAALCFAALPTYSQFVKK

SEQ ID NO: 780968 - protein, 91 aa, Homo sapiens
VTLWLHFCLWGPSTRDTGTLLQSMGICSLPGTALGSSGMEEASLGGSHYFLRSRRFSLLPASTSPGVPASRLHHPAASFSLLGTFGKRHRN

SEQ ID NO: 780969 - protein, 79 aa, Homo sapiens
MLCPRLWHWAAPEAQEERDSPQHRLSTGEQRNQTLPLSLLEGRSEHPCPPNPCHAFLSPRRGHGIVLEPQHWSDSDSHS

SEQ ID NO: 780970 - protein, 75 aa, Homo sapiens
FRFHPEHFLDAQGHFVKLEAFLPFSAGRRACLGEPLARIELFLFFTSLLQHFSFSVPTGQPRPSHSRVVGFLVTP

SEQ ID NO: 780971 - protein, 80 aa, Homo sapiens
ICTQAKESGPGHLPHSPQKEPITAWESECRMKERESRCGRGLKLHHGERHTVTTKSEGQRRAGGCRCDRTWSIGVVMSCR

SEQ ID NO: 780972 - protein, 230 aa, Homo sapiens
MRPFSEETLATVDYSVTAQYDAGLLHREHVLTPKPCGALMYRHHHPITRAGTMAEIPQAPQTKGLAAARRASRALLTHTMRPIHRPCPRQSNDTHARSCNHYPRSCTTDLTRNTMPTTPKPPLATAPSTPTPPSPHADPAPPPPTCRGNRDPTTPPAPLDSSTPPHVCPQPTPPPPFAGDDPLSAITRHYDQNRVHHGLPRLNQHSIGNSYITLADPIHAALPHHTPPLS

SEQ ID NO: 780973 - protein, 65 aa, Homo sapiens
RLTCPEVCVSEIGSYATVSACISASSCYIRKLNTESPCNWRTSRRPSLWFFVSGWDGVGCGLQAA

SEQ ID NO: 780974 - protein, 98 aa, Homo sapiens
TDSGGRELQGQIPEPSEGDSGNQLLSGGQSLEPWGRSRVQQRGCCPPWLALPLALAPAPGKCKAQERHHKALGCPSCTFLRWQAGDASMSLHPRKMLC

SEQ ID NO: 780975 - protein, 44 aa, Homo sapiens
EGRCVSIIFMRAGGGTSALRCLGSKAWNPAVQRNVGDVASGAEM

SEQ ID NO: 780976 - protein, 50 aa, Homo sapiens
MSSSCDPACSAKARGAAAVTEERETPERNLVQRNPDSNSSDISPESFLNS

SEQ ID NO: 780977 - protein, 72 aa, Homo sapiens
QVAWPALTQMHAAQRLVPDLAMACSVGWLAARQEGGPPVCLASHTSSRMLANTCLSSSFGQERKFTGTESEG

SEQ ID NO: 780978 - protein, 56 aa, Homo sapiens
YTSKYVLSEESKSPTRAKFPRQPSSEGTQVWSGDLMGCLEVSDSSDAPETTQKSSA

SEQ ID NO: 780979 - protein, 135 aa, Homo sapiens
MRRCAAWTHTHTRICCLDAHTCRYGIRTHTCTDMLPGHTDNAALTHTCTDIAWTHTHTRVHRYAVWTRTHMQICCLDTHFQTHVHRRRYAAWTHADMLSSHTHTQTCCPDTHTHAQICCPDTHTHADMLPGHTHR

SEQ ID NO: 780980 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 780981 - protein, 490 aa, Homo sapiens
KAVPVRDYGIAPSPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 780982 - protein, 350 aa, Homo sapiens
MRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 780983 - protein, 584 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPGARLPRHATPCWCPDPPPGPGVPPTGWGPTLPSRAVLARSSAEGGQPRGTVSTAPGMGLGCSPGLCVGVPLPTSFPLALADPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 780984 - protein, 497 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 780985 - protein, 123 aa, Homo sapiens
MRDFPCSTVTPPTLPASVPASVPASIPASVPWPWRLFLPPALGAQESPTAVGWGWGHSSPKPERLEPMASGSSPLHSPPDTEKGPWYLYLRNEDNINNDGRKTGLQGLWSLLGPGTRLVFQPC

SEQ ID NO: 780986 - protein, 504 aa, Homo sapiens; identical to SEQ ID NO: 780980

SEQ ID NO: 780987 - protein, 290 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVGAGKRLLPQTTAVSWGTGGVLSDPQWGILLER

SEQ ID NO: 780988 - protein, 504 aa, Homo sapiens; identical to SEQ ID NO: 780980

SEQ ID NO: 780989 - protein, 504 aa, Homo sapiens; identical to SEQ ID NO: 780980

SEQ ID NO: 780990 - protein, 504 aa, Homo sapiens; identical to SEQ ID NO: 780980

SEQ ID NO: 780991 - protein, 78 aa, Homo sapiens
STWVFLLLHFSLFISFYKCKLIYEEASSPSRETISSGLSVFHSGYLSIHHLTQTVGTVFYGITSTDDSVVPQHTYCCF

SEQ ID NO: 780992 - protein, 623 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 780993 - protein, 46 aa, Homo sapiens [sequence omitted]

SEQ ID NO: 780994 - protein, 661 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 780995 - protein, 311 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHR

SEQ ID NO: 780996 - protein, 142 aa, Homo sapiens [sequence omitted]

SEQ ID NO: 780997 - protein, 151 aa, Homo sapiens
FCLLQPVQAQNVLNSASPGRAHPPSASTGPSPASQQPPLVQLLLSCLAASVGHRVLKVKLSRPTFGLPAASAIKLFPHCGHRKPSFSLPHSILRKLSICLTVASPGHESACLPGSCCLTMVSLGPALAKRQTLQAQLLPPGRLCRPKFSKS

SEQ ID NO: 780998 - protein, 66 aa, Homo sapiens
PTNNFSLLFGLCLRASVLKILASGFQTSRLCSEPNPCWMVAHFITQKPQLLLVLGLMLCSFFGQLN

SEQ ID NO: 780999 - protein, 235 aa, Homo sapiens
MANPLTAGSLELSESDNFQTSHVLPSTRYILEKKRRRKKMKKMKMKKKMMMMNKLVLAQFFFLVYKAFNPPVHNSLLLKKKIEMKGCVRFVFKLYSVFFGIVNTLPNVSLDSPVLVVFSIATNLAWYSMGVVNWHGNLKQVLVGAQHKLVIYGDGSFFIFIVSDAAYTKYWSSWLTEYHSANLQTQPRHHSRREHTFVGPIWPPAEKAFKKTMACEPGGPRGNMNLGAEGVPTGI

SEQ ID NO: 781000 - protein, 108 aa, Homo sapiens
MQFLISVKGPPGVQQQADLRTKVKWWQSAGPDVRSLQFALDNNNPQVTLRKVISVSPLVNNEHLPRLIFTGPKGRWWRTTESKVIQKLIPGEDFSIQNLQLMTGVKVW

SEQ ID NO: 781001 - protein, 106 aa, Homo sapiens
WADRGIHHPPGIPPIPPFTFPPLPLPLLAYKLAGVVGVNQRGIMSQHPQQEVHLMKSCVIYFLGEVGARRIWDPHLLASSEWLPCAKKENSRQTGTQAPAPMPQPL

SEQ ID NO: 781002 - protein, 37 aa, Homo sapiens
MNEKSDSNEQDESVPEEMPYACKNNFMLKALPEIIHN

SEQ ID NO: 781003 - protein, 89 aa, Homo sapiens
REHPPTRSQPQGSTDPQGSTLDHFRKILNLSVGQGAPGGTHTGLLPDGKWPQRAWGREDFCKAVSPQHSLGKPCVPSAINLHLLKVYAP

SEQ ID NO: 781004 - protein, 119 aa, Homo sapiens
GSGIIAEGPLRPQFLSGTINKLAIRTVKLNQHAPIQIRDYFLRIATEHRRQKSNSFMRSTSYITHSYTSKMVLSVIVVHIHTCTYTHTYVRTHVHTDTKLKVLLILNDQIQLFVVGSGR

SEQ ID NO: 781005 - protein, 83 aa, Homo sapiens
THACADAWVDPRVGDSSSPTGLQLETWHSLKCFVAADNLQFTIFGLVFIVHQNLAHIGIYWTARLMQSISASSFPVSMHLLYA

SEQ ID NO: 781006 - protein, 60 aa, Homo sapiens
MAVGKASLGSTLPGAGHACLRGSWLQGSEGPHAQPQEGLPISALATSWCSLVRRGFLGCT

SEQ ID NO: 781007 - protein, 167 aa, Homo sapiens
AAGRWAEGVRTPRTAMPGDHRRIRGPEESQPPQLYAADEEEAPGTRDPTRLRPVYARAGLLSQAKGSAYLEAGGTKVLCAVSGPRQAEGGERGGGPAGAGGEAPAALRGRLLCDFRRAPFAGRRRRAPPGGCEERELALALQEALEPAVRLGRYPRAQLEVGAAAQP

SEQ ID NO: 781008 - protein, 239 aa, Homo sapiens
AAGRWAEGVRTPRTAMPGDHRRIRGPEESQPPQLYAADEEEAPGTRDPTRLRPVYARAGLLSQAKGSAYLEAGGTKVLCAVSGPRQAEGGERGGGPAGAGGEAPAALRGRLLCDFRRAPFAGRRRRAPPGGCEERELALALQEALEPAVRLGRYPRAQLEVSALLLEDGGSALAAALTAAALALADAGVEMYDLVVGCGLSLAPGPAPTWLLDPTRLEEERAAAGLTVALMPVLNQVAG

SEQ ID NO: 781009 - protein, 121 aa, Homo sapiens
DKKRSPGSGSTMRLVFSRFSIVPHSIPGASLMPAACWRASEGQSATGTVWRGLAANPGWLCLSGARGAQLFSVSPGAEAGRWADGQGQASERLEEAVRVWAGPLHHRAPRSRIQFSKHSAE

SEQ ID NO: 781010 - protein, 102 aa, Homo sapiens
GILYENELFQTQTIYLFIYLFMTDRVLLCSPGWGALIMAHCSHNLPGSSSLPTSVSQVARTTTPSQGQFLKQVWAIQIVLPEFFQNARITGLSHRTRPKLLF

SEQ ID NO: 781011 - protein, 108 aa, Homo sapiens
MTIPFLSWRLGLGGLSELIFCCEYLWDNFTSSPPLALRSLDVSGGSWKPPAGVPGLALPFCLLPALLTHLHMPPRLPYRIHPISLKQVFGKLCGAEGKSRSLVFHMFP

SEQ ID NO: 781012 - protein, 289 aa, Homo sapiens
WSQLELPRPCEQVAGVPSCIGERAVLKAKVIFGGRTGRLIKSGKFCTKLSCAAQSRTRVQWRPVPTLSRLTSAGARLGNLAGKASQVPSASHPLPLTSRGGREEPPSSSQKGLDRGSSSQGHLLCLLPRAHLSSGSSRPTMDSAAKDEMQPALSPGPEWPEQERAEQLARGAALKWASGIFYRPEQLARLGQYRSREVQRTCSLESRLKAGNDGELELGPEADVSQLEPLLTLENIEQLEATFVANIQASVSQWLQNALDGEVAEWGREHGPNTDPSGSYYSPMPAIVL

SEQ ID NO: 781013 - protein, 226 aa, Homo sapiens
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLGGLELPVFQGLDLLFEALGQAVEAAAGAAGKLAREDPALLVAAVRV

SEQ ID NO: 781014 - protein, 228 aa, Homo sapiens
RKCTSLLMHKNSWAPLETERHGKPGLLRRKLVVGWKGKGEHLSLLVDVEAPKIRGPGDSCLPASHCHLPLPGTSLFQHQSSTSFQEALEDRAKWLGAVAHASTPSTLGGRGRRITRSCPSTFQKKKKRGSQTRRTLKPQPQQLQQNLPKGHETTGHTYERVLQQQGSQERSPGLMSEDSNLHYADIQVCSRPHAREVKHVHLENATEYATLRFPQATPRYDSKNGTLV

SEQ ID NO: 781015 - protein, 123 aa, Homo sapiens
MGNRVCCGGSWSCPSTFQKKKKRGSQTRRTLKPQPQQLQQNLPKGHETTGHTYERVLQQQGSQERSPGLMSEDSNLHYADIQVCSRPHAREVKHVHLENATEYATLRFPQATPRYDSKNGTLV

SEQ ID NO: 781016 - protein, 38 aa, Homo sapiens
MPCCTCDKCHFFFFVKKRSGSFSCAITEQQMRFFLPPN

SEQ ID NO: 781017 - protein, 122 aa, Homo sapiens
RQAKPASGGLFHRHSFIGWCQVAGPHRHFTLEMEDGCCFCYNLLFPLFCMILNSPLPDLPASFSCCHLLPAIVTSPLDTPVAVISRTARNPLASNSRYPSTSPAGRPSAFLLLHWVCVARLP

SEQ ID NO: 781018 - protein, 72 aa, Homo sapiens
ADRRLWRLQAHEQQRNNLWGGLGDLGLHSFLGKLRRCVPEDCQLIPLHTQYCGILGYSLSLLMAQSYALDKD

SEQ ID NO: 781019 - protein, 114 aa, Homo sapiens
VTKNAVPSLCNMGKNSVLGQNRAEKEECEQTAWTSHYLLKSSCGWGGFGRALMVSHLATAEATFLKQSLMEAKVSVEEAVLRQALAQHTGRLGDSWMSEGRRLPPGTPSHFGAH

SEQ ID NO: 781020 - protein, 306 aa, Homo sapiens
MGTPAEGGIYHGKGRAGRLGSQFHPRTGCLARPAAGGDVLSRERWPLETCGQKGKRSGLWWGPAWGGVGQGQLPFLHAGEEMLCACEKAFDSMPKVSSIMCVSSVDQVRTLVLCECAHADRSGGAPSLCPHAAEPRGSPAPQACGSAAKCVRCASWVLLCALSYGDTGGVGLDRYRSDYGDTGGVRLDRYRSDYGGTGGVGLDRYRSDYGGTGGVGLDRYRSDYGGTGGVGLDRYRSDYGGTGGVGLDRYRSDYGGTGSVGLDRYRSDYGGTGGVGLDRYRSDYGGTGGVGLDRYRSDYGDTGGVG

SEQ ID NO: 781021 - protein, 218 aa, Homo sapiens
MGTPAEGGIYHGKGRAGRLGSQFHPRTGCLARPAAGGDVLSRERWPLETCGQKGKRSGLWWGPAWGGVGQGQLPFLHAGEEMLCACEKAFDSMPKVSSIMCVSSVDQVRTLVLCECAHADRSGGAPSLCPHAAEPRGSPAPQACGSAAKCVRCASWVLLCALSYGDTGGVGLDRYRSDYGDTGGVRLDRYRSDYGGTGGVGLDRYRSDYGVKLPVGIL

SEQ ID NO: 781022 - protein, 119 aa, Homo sapiens
CGLCWQDKVLRGRLTLHHGQLLCLRRTADLLFCRHHAEAEKKVVTCKMVSSLRQDPQMHGAAPRVEWRHERLGLMWEAVHARGGGGFSEQKSPGQTLNSLHFLDRNTIGMGKAGFKAEV

SEQ ID NO: 781023 - protein, 52 aa, Homo sapiens
RCYLDPLPLTQRDALRKTHNKGPTILLPGVHILSPCCPLPACLEIFAAKMWS

SEQ ID NO: 781024 - protein, 60 aa, Homo sapiens
YLEDPAPRRTAEGDNAESASKLRPRPLGRQRHSTTRQRGHLHGYTATSDTLDQALQKWNW

SEQ ID NO: 781025 - protein, 55 aa, Homo sapiens
MLETQKETLHRTAEVDGAALQTAGAGTLGEMREEGQEGLGAANIGGDLRGEHKGS

SEQ ID NO: 781026 - protein, 120 aa, Homo sapiens [sequence omitted]

SEQ ID NO: 781027 - protein, 121 aa, Homo sapiens
WKVPFHSVQRDLDWSFLDLREEWGEVVSARKLLGGLAVTEHVVTAPGWARLGAAVTATAQSPSALSLEMASPSVQVAVGFDLTGVGADEEVQATQGLGFLSCSELFALLWKLRSSDPLPLV

SEQ ID NO: 781028 - protein, 48 aa, Homo sapiens
MRFAKKHNKKGLKKMQANNAKAMSARAEAIKALVKPKEVKPKIPKGVS

SEQ ID NO: 781029 - protein, 94 aa, Homo sapiens
GWEFLDKGRPLFTSSFTSTHSEIFWLWEVLTVAGKTASLLETMVEGSQDPSLALLSGCLYFRSPPLLVPLHSHSFFLFSSLSQQVFYVITGTAW

SEQ ID NO: 781030 - protein, 37 aa, Homo sapiens
MVSQSLFGAGVVVSVQPGLGSLPMTRKNKTYRHQRVS

SEQ ID NO: 781031 - protein, 122 aa, Homo sapiens
IAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLK

SEQ ID NO: 781032 - protein, 144 aa, Homo sapiens
STSCLLVRLPLPQEPLPSSLSLHSEQFIHSADIYCILSMKVWEAFIMHHYILGITLLQLPFLLFFLNAGVLEILTCQLALLYLFLHATPQSFNEHLSYTTENPALNASSPLFVVPIPPSTISILPFTQHNPESSQCALFSIYSS

SEQ ID NO: 781033 - protein, 68 aa, Homo sapiens
YNLKFSSSVALTTFQVSSDHMCPAATISDSTKNISIITEQQNLTLKIFRLRYNSSEKNGKKTFHSLSS

SEQ ID NO: 781034 - protein, 102 aa, Homo sapiens
LTLLNSSNPPASNSQSVGITGVSYRTRPCSYYLFVCLFVLRQSLTLSPGLECNGSISAHCKLCLLGSHHAPASATQVAGTTGTCHHAQLIFCIFSRDGVLPY

SEQ ID NO: 781035 - protein, 75 aa, Homo sapiens
LSTFSEHSCEPWISILQNFRVLRNAVSIPTGCYGIIMKTSRPVLVCFKRGALSNPPRTLVARRGCCGNRSWPGWP

SEQ ID NO: 781036 - protein, 89 aa, Homo sapiens
GETAACSLSSKVSNQSASRGAPVPSSPGVATTKHRQPGGWNNGHSLSYRSGGQKFQIQVLARLVPLEAARETVPSPSPGFWWLLTIWRS

SEQ ID NO: 781037 - protein, 104 aa, Homo sapiens
SSPLKRTGSFWPQGLCRPPMQEQKFPSSLLMEFDLVEVSTLSPQPRALGSGSCLAKTPALDWLRYQHIMQHWPERHEWMFAGGLWEKISLLYMRVHAHTHTLLL

SEQ ID NO: 781038 - protein, 120 aa, Homo sapiens
VPLGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQ

SEQ ID NO: 781039 - protein, 114 aa, Homo sapiens
TLTSSLNHGSVPKTNKIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKA

SEQ ID NO: 781040 - protein, 145 aa, Homo sapiens
FRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKS

SEQ ID NO: 781041 - protein, 134 aa, Homo sapiens
RAGIPAGRARARLPGPPAGGKPDELDWGRPPCAPGGFRLSYSLSPLSFAPSECSRGRSPWPPVPWPPFLPVQTKPSRPPPPPPPYMIAEDPEGCPGGARGLSSDTGRKPGRKWKSVQTHLPSFGNFKKKRDCIN

SEQ ID NO: 781042 - protein, 75 aa, Homo sapiens
SSSHPAILVHREGKRIKTEELFIECDQEVVGGLNESNLSGLMGTKTKMIEKRIMKMDIASIGNSRSLVMKGREIE

SEQ ID NO: 781043 - protein, 160 aa, Homo sapiens
TRQCTLAPAVDSKIPRGGSCSSPSRIFGGLHVSLGFCLFSQRFLLAQSLTLSPRLECSGVILAHCKLHLPDSSESPASASQVAGATDTHHYAWLIFVFLVEMGFHHVGQAGLELLISGDPPASASQSAEITAVSHPMPGCFLYYRVAALAYFEDKLLVIN

SEQ ID NO: 781044 - protein, 162 aa, Homo sapiens
ENWLAICRKLKLDPFPTPYTKINSRWIKDLHVRPKTIKTLEENLGSTIQDIGMGKDFMSKTPKAMAAKAKIDKWDLIKLKSFCTAKETTIRVNRQPTEWEKIFAIYSSDKGLIFSLPSNLQNPANSESIITIIFFYSNIPCAQCTLAGFLPDCGPCIVLSGD

SEQ ID NO: 781045 - protein, 227 aa, Homo sapiens
ALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVRCER

SEQ ID NO: 781046 - protein, 137 aa, Homo sapiens
SDLTTASISVKGDRALPGHCSCALRPPHQEEELACQTKAEKSLCVRSPGGKGGEGSCVNNIHLVSCCYARHTGGIFHTRSFSPGIPVLYNLCLGLCVHFSWGKGHTTSLLYENYRILLFGRLRQENRLNPGGGGCSD

SEQ ID NO: 781047 - protein, 141 aa, Homo sapiens
GASPCSRAFSGFRGGMKEMPSEAGDLLSPTHGPGGSLTTGREEEEWPGLTAPCTADRGKLCINRASVCRGRSSGTSPGVPWSRGPAKCSVTALSLSCTCSHGPGTSELSRRGAAWCRLSPQLFAQFVRLRLARQKEVICFW

SEQ ID NO: 781048 - protein, 235 aa, Homo sapiens
EFPLSPSQCSSFNLAMASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAVIRDFYNPLVAEAQKRELGASLYLGWAASGLLLLGGGLLCCTCPSGGSQGPSHYMARYSTSAPAISRGPSEYPTKNYV

SEQ ID NO: 781049 - protein, 1237 aa, Homo sapiens
HCPWNLQGSYCITSSETRHFYITMERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 781050 - protein, 1113 aa, Homo sapiens
HCPWNLQGSYCITSSETRHFYITMERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 781051 - protein, 1000 aa, Homo sapiens
MAVTQFIHFREDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 781052 - protein, 1057 aa, Homo sapiens
MIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 781053 - protein, 232 aa, Homo sapiens
MGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 781054 - protein, 217 aa, Homo sapiens [sequence omitted]

SEQ ID NO: 781055 - protein, 175 aa, Homo sapiens
MAVTQFIHFREDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEISCGIQFLLTLLL

SEQ ID NO: 781056 - protein, 1036 aa, Homo sapiens
MAVTQFIHFREEIMGNMFFIIIFSTKDKLCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 781057 - protein, 1347 aa, Homo sapiens
GPPVRSVLASGSTPRPRSPTRASPAVAARTRTPRVSRARRPALPTRAHLAHGRTHVCPRAPGARRRRQGQRQKQADRAGQYRSGRHGLAGLAMEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 781058 - protein, 362 aa, Homo sapiens
GPPVRSVLASGSTPRPRSPTRASPAVAARTRTPRVSRARRPALPTRAHLAHGRTHVCPRAPGARRRRQGQRQKQADRAGQYRSGRHGLAGLAMEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEISCGIQFLLTLLL

SEQ ID NO: 781059 - protein, 69 aa, Homo sapiens
KFNKGKKMRKVREEVTGDGKGNTQEGSQAQPEKQQQRTTPNENKQETKQLHRHGRRKYLWREEGTGQVH

SEQ ID NO: 781060 - protein, 61 aa, Homo sapiens
ILGRQSSRGKGTISFIRQISKHHLSVCSVRTQGTGGRTDVVDRNAVISTIFCSCKTLIPYR

SEQ ID NO: 781061 - protein, 82 aa, Homo sapiens
SAETLSSPRCSLRGSRAPARAVRLLGSRGIASEYRGISKGPRGEEGWGEERVAERRRTLPFVGSFPSPPTPQKHPGQNAKSG

SEQ ID NO: 781062 - protein, 197 aa, Homo sapiens
MTNTKGKRRGTRYMFSRPFRKHGVVPLATYMRIYKKGDIVDIKGMGTVQKGMPHKCYHGKTGRVYNVTQHAVGIVVNKQVKGKILAKRINVRIEHIKHSKSRDSFLKRVKENDQKKKEAKEKGTWVQLKRQPAPPREAHFVKTNGKEPELLEPIPYEFMGINRWLTTQKLTDLSGLQKTRRKSQKRTKTFVRPPVGP

SEQ ID NO: 781063 - protein, 180 aa, Homo sapiens
SFSARYLDFSEKLKPEAFHEAKHRTEGLLVMGNLLKVLTREIENYPHFFLDFENAQPTEGEREIWNQISAVLQDSESILADLQAYKGAGPEIRDAIQNPNDIQLQEKAWNAVCPLVVRLKRFYEFSIRLEKALQSLLESLTCPAVHNQKAPNSHGKGNRPWQKEDKGVRYGHPGKEVYIQ

SEQ ID NO: 781064 - protein, 46 aa, Homo sapiens
MHTSDADFSISSSLTLLISTEYPRDVHLHECDGHYWNVQEDDMEKS

SEQ ID NO: 781065 - protein, 110 aa, Homo sapiens
MGSSGLPTYFPWEARAAATLLYIVQSEGHPGSRGRVRAPSSLAAAEGSQPPSFSVSPRHHGPPRSMGTQCHLPSIPTPGRRLTRVQLERAGEVSLCKSESKSGSHSCKVL

SEQ ID NO: 781066 - protein, 87 aa, Homo sapiens
MPFLLGLRQDKEACVGTNNQSYICDTGHCCGQSQCCNYYYELWWFWLVWTIIIILSCCCVCHHRRAKHRLQAQQRQHEINLIAYREA

SEQ ID NO: 781067 - protein, 167 aa, Homo sapiens
TVRLSSKEIMHVLGTVLAHNKGCINIGDNYCYCHLLFFFLETESRSVAQAGVQWHDLSSLKALPPGFTPFSCLSLPSGWDCRRPPPRLANFENIWLGVVAHAHLGLPECKDYGREPPHPADTDFSFQRGQSPGRGQSRDNCDMTYVSQDHSGCCLDKKSKGVRVKAG

SEQ ID NO: 781068 - protein, 947 aa, Homo sapiens
MARKKPRNTSRLPLALNPLKSKDVLAVLAERNEAIVPVGAWVEPASPGSSEIPAYTSAYLIEEELKEQLRKKQEALKHFQKQVKYRVNQQIRLRKKQQLQKSYERAQKEGSIAMQSSATHLTSKRTSVFPNNLNVAIGSSRLPPSLMPGDGIEDEENQNELFQQQAQALSETMKQARHRLASFKTVIKKKGSVFPDDGRKSFLTREEVLSRKPASTGINTGIRGELPIKVHQGLLAAVPYQNYMENQELDYEEPDYEESSSLVTDEKGKEDLFGRGQQDQQAIHSEDKNKPFSRVQKVKFKNPLFVLMEEEEQKQLHFEGLQDILPEAQDYFLEAQGDLLETQGDLTGIQSVKPDTQAVEMKVQVTEPEGQAIEPEGQPIRTETQGIMLKAQSIELEEGSIVLKTQDFLPTNQALLTKNQDVLLKDHCVLPKDQSILLKYQDQDFHPETSMFSTKTKIFCHNIRTRIFYLRTRIFYLETSMFSPKTKIFCQNIRTRIFYLRTRIFCLETSMFSPKTRIFYLNIKTRIFYLKTRTFYLETSMFSPKTGIFYPNVRTRIFYPETKVFFPKTKIFYPYVRTRIFYPETKVIFLKTKIFYPYVRTGIFYPETCMFSPTTRIFYPNVRTKIFYQNIRKYTLRSQYSDMTDEKGREDFSLADYQCLPPKSQDQDDIKNQQPASFMREERVREELPLDYHQYVVPKIQDQDSPREQNKHIKLPSSFEKWEIARGNTPGVPLAYDRYQSGLSTEFQAPLAFQSDVDKEEDKKERQKQYLRHRRLFMDIEREQVKEQQRQKEQKKKIEKIKKKREQECYAAEQRILRMNFHEDPYSGEKLSEILAQLQLQEIKGTREKQQREKEYLRYVEALRAQIQEKMQLYNITLPPLCCCGPDFWDAHPDTCANNCIFYKNHRAYTRALHSFINSCDVPGGNSTLRVAIHNFASAHRRTLKNL

SEQ ID NO: 781069 - protein, 43 aa, Homo sapiens
SAGEQGGEAGAAETGGSAGAGDPGKQQAPEKPGEATLSCGLLQ

SEQ ID NO: 781070 - protein, 459 aa, Homo sapiens
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETAQQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQIT

SEQ ID NO: 781071 - protein, 1050 aa, Homo sapiens
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETAQQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 781072 - protein, 751 aa, Homo sapiens
MPRAKENELQAGPWNTGRSLEHRPRGNTASLIAVPAVLPSFTPYVEETAQQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 781073 - protein, 68 aa, Homo sapiens
FDVSKLTRSASSRLQETCLPGIPFKQLINMSCGLWSEESVRAVEMTHQLSSRVFGKRYPVSKRPPAEK

SEQ ID NO: 781074 - protein, 107 aa, Homo sapiens
SSVKLSFQLHSLKRPMAFRWFLTLLQLLSAGLKASFRPDGHEAVMSIPTHARLEGAPGTFYVLVFVLQVCKVLQLRSKPASLLNKRLTLGCVELVLNCHLRASGVTF

SEQ ID NO: 781075 - protein, 35 aa, Homo sapiens
GSPFSGEQGGPVSGQAEVPDLLPSWPLQGPGKFLA

SEQ ID NO: 781076 - protein, 56 aa, Homo sapiens
METHHPHKANAEEMTKYHSDDYIKFLCSIYPDYVSEHSKRMQRFNVSEDCPAFDGL

SEQ ID NO: 781077 - protein, 60 aa, Homo sapiens
MCPLKEGDCRAVSSGSHGTSRVGLAQHRPCEAQSSEGPRALLGVRVAGTTWTVTCLLNTV

SEQ ID NO: 781078 - protein, 68 aa, Homo sapiens
APSTTRRTPRYINVVNNLQWEPTQPKFFNQTSEFKSCFNYCVTPGKCLNLSGTLIPICKVGSIAMPVF

SEQ ID NO: 781079 - protein, 48 aa, Homo sapiens
MLREASGGPVMEEGDGFGSQAKECGLCPRGSREPWRVPDLNCTLERIV

SEQ ID NO: 781080 - protein, 56 aa, Homo sapiens
MLSEGIDEFQAWEQNNWIYSKKLIMAVSQREERTESKSRGEKANERLLHVDDGGKE

SEQ ID NO: 781081 - protein, 33 aa, Homo sapiens
MIERLLCDQCCTLYFGPLFFLEVEMQVCIYKKN

SEQ ID NO: 781082 - protein, 128 aa, Homo sapiens
SGYLGLLAHPDCAKCWCGPCTEALAIFWSFSTSSFSKPLPLSRLQTLYGNHWSTAADIQTELPMYRMRFPAHYKHCQCPVMGTGVSTHVPLQREIVAQLPRVPWQTGGYGSQPFWGSILLERDLSGAM

SEQ ID NO: 781083 - protein, 107 aa, Homo sapiens
LLALNTTCRPQLPHLACLLSKTKPHEATGQGEGPCVLRVPRQKCGSGRNGGVCPSLNKHIPSVWRSPSKIYKCCDDTMLIQTTGCRQIAEIRKGSVLGGRIWLLLVP

SEQ ID NO: 781084 - protein, 35 aa, Homo sapiens
KPLSPASSEARKERRDQNERAHTWNTIHRNKSLME

SEQ ID NO: 781085 - protein, 146 aa, Homo sapiens
MAVGLQEGQFFFFSLFFLRRSFTVAQASVLWQDLSSPQPLPPQFKRFSCLSLPSSWDYRHVPPCPATFVFLVETGFLHVGQAGLELPTSGDPPTSASQSAGITGVSNRARPKGGSYYYYYYYLKWSLALSPRLEGSGAVSAHCNLS

SEQ ID NO: 781086 - protein, 108 aa, Homo sapiens
GVFITASSPWLQSIQKGINSLTLMICKGKETPQTKTITATTKNCFRLGGGPKGRNKGQALTLQVLTDLFVMTMEFSLLYSHIFSLHWDLHFFFLFLSFVTFDFLLFLS

SEQ ID NO: 781087 - protein, 137 aa, Homo sapiens
EPEGLHCTELAQGEAGAGPGTQPPRRKPERKPAWSCSLPRPNPRLLPNADPLAECLLVCIHASHTAQPKFLQLVQVQSPQNYKARKDHLWAQELTVVLPLPEGTMTRTVPSFAAILNSPSTQHIQLNQSKSSFPAGK

SEQ ID NO: 781088 - protein, 137 aa, Homo sapiens; identical to SEQ ID NO: 781087

SEQ ID NO: 781089 - protein, 137 aa, Homo sapiens; identical to SEQ ID NO: 781087

SEQ ID NO: 781090 - protein, 137 aa, Homo sapiens; identical to SEQ ID NO: 781087

SEQ ID NO: 781091 - protein, 137 aa, Homo sapiens; identical to SEQ ID NO: 781087

SEQ ID NO: 781092 - protein, 174 aa, Homo sapiens
SRKVNSRTEKEIQKLNFLKRNSGTEREANGKYPNDKKKTTKKTQKHMCAARATARHPSKQNSQETNAERERRRRTTRRTTAQARHTAAQREEEHRRHSTNKEEGDNNNTKTNYKDHRRKQKRKLNETTNKKKYDNTDESNTQTTPTNNTGTAQKEKATTKKKKNSPPRKSGNRN

SEQ ID NO: 781093 - protein, 106 aa, Homo sapiens
RNSDYSYLMLILFSSLDNPTFLGSRPITSHMRNLCPAQTGLLFLEHSMCHLQYLCLCLQHLCCFDLTTTTTLPPSRTQNLSPNNSPTSISNHILGSFSRVLETPTY

SEQ ID NO: 781094 - protein, 120 aa, Homo sapiens
QAGQACDPPAQPQSIWAPGQAWSIEQLSWYWGPEPGVGMNKTLMIPQNEEGTPWLMPVIPELWRPSGEESLEPWTLRPTWAIQQDPISRKKIFKTELGSQVWWLTPVIAAFWEAKVGRIT

SEQ ID NO: 781095 - protein, 70 aa, Homo sapiens
QVCSEREADCGQEPRRFVGFRPGSLGWASESRAGSGCGVLTHWYQQVLKQQVVTPHPGPHPALLAWPVLR

SEQ ID NO: 781096 - protein, 69 aa, Homo sapiens
LENKWDGGVREREEAQGMAVLNCGIGNKTVIEFSRLEHIEFEMPDNAWVKMISNWKHGSKLEQKFKLDM

SEQ ID NO: 781097 - protein, 109 aa, Homo sapiens
NDRHLLLVGWASCIQFSQHPCEVVMLIPILQGRRLRPREVKSCATKYPSHMVVEPSFQPDSPAHSRAALDSTAIQCIAGPLHHSRQFNVKIPDLPQPGASRRYHHPQQA

SEQ ID NO: 781098 - protein, 389 aa, Homo sapiens
AGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 781099 - protein, 135 aa, Homo sapiens
AGPVVNTHMPKDRVTGQHQGYGFVEFLSEEDADYAIKIMNMIKLLWLPAGASPSTQTHSPATSSPSRPTSRPSPSVNSHFPSSCYIFPISFLFLGPIRDAVAPWGKGTNPFQHPHSIPLFNVTFSTGGISFLCWS

SEQ ID NO: 781100 - protein, 96 aa, Homo sapiens
PASLPPCSLISDCCASNQRDSVGVGPSEPREGFNLLVCRFLSPSAKRSIWVGVTRFSRCRPSPLSLTRKRNSLTPCAFRVRQCLALLQLAHGARTH

SEQ ID NO: 781101 - protein, 66 aa, Homo sapiens
GLTGACGLTVACGLTGACGLTVACGLTVACGLTVARGLTVALSSLPQSSSMSPPAQNLSHFALTFE

SEQ ID NO: 781102 - protein, 143 aa, Homo sapiens
CSSCTVNTLCLLHTLSKYLLNDRIDVAAGTLPQLLVHLGRSFPKNTLGSFPPSLCSPGAQRLKALNLLISPRLPPYLSPFSSAPYTPPRWLHSSFPECARLLCDHLLSVQLAIPGLPSSHISGLSSDTRNPTMYLPSTAILLC

SEQ ID NO: 781103 - protein, 102 aa, Homo sapiens [sequence omitted]

SEQ ID NO: 781104 - protein, 115 aa, Homo sapiens
FLLLLYYSRYIAGTPCVWIDELHEFCQGLPGKTLSNMNKLSFSCFKSSPAQFTCAPEHSPSSLLNLAERPFAFGLGMLGAHPTRSSSPSHLASAEEVAELLILADMMFTAASITN

SEQ ID NO: 781105 - protein, 119 aa, Homo sapiens
WTPPGGAPGALPTTCSKDTASWKRPWFPFGGELVQGTSRSRSLRWPGQAFSLWVLPTSALGLAMRSSPAPRDQDPPAAPAAATRGQQASAARIPGSQPGLDRRALAGCLAPRASVSLSI

SEQ ID NO: 781106 - protein, 71 aa, Homo sapiens
CTICGQWGIPRLTSPSDPAQTTAPMGFPFLTSSVSTLVSVGQSFLIAAASPSLSAWIIPEGSGYLFPMPFP

SEQ ID NO: 781107 - protein, 114 aa, Homo sapiens
MGGLRKLTVMVEGEGEAGTFFTMHQEGVCARTMKCPSLKPSALMRTHSLSREQHGRNSPHYPITSHLVPPLTCGDYNSRCDLGWNTEPNHIRRKRGKRVDEVKLVNGYKNAVRK

SEQ ID NO: 781108 - protein, 61 aa, Homo sapiens
FFLSTASGEPAPSRYYRCPDSAHSSRGWGQWEVCLLLRTRSRRTSVPRSHVGNGDLAAWQP

SEQ ID NO: 781109 - protein, 222 aa, Homo sapiens
HGCQEADRGGSWGATTSRPFRQNLSDLGRHSVLPLKRNLCPGGSSLGAPPLRTPQRRVTLAAQRWLSRPQRRAVGLGELDQGAQLAALGLRWGVDSLGGCPRASQPAGHSGLHHTLTCLRRHLALQAGASGHAGQLPQRASAAWEQQGQSYTALHLAAMYLGDGEAASGNIGRHVDIRDYTGKRASQHVSQSITEEIETLMGVLDKDDGESTASSGGEYWKI

SEQ ID NO: 781110 - protein, 71 aa, Homo sapiens
YTSNMLSLQMPESRITLLCYRSPELLYLAKLKNSIISQTQNSTILHSLFLHPMATTILLCLYEFEYYRYLI

SEQ ID NO: 781111 - protein, 136 aa, Homo sapiens
NENGNRGRSEVDVQNTQYHSDFFPHVALLTLATLFKIAYCGGGWEEVVRKCMFNLFTCLYFLFLKFFNAFYDIAIPISTMLVSSGLPPCFFHAFSQRSDSQFAYTRPKFLDYSQSKSTYRHRGNTEIGDDLILFNF

SEQ ID NO: 781112 - protein, 198 aa, Homo sapiens
MRALPGFDPPLITGDSRCPAGPTGNRSQSGLGHPLQVVHSPHRLMVESRLAWDMWASRGDRRNFQTSKAPEASTPAQAQFKPSSSWGYFCDGWVGAGASSSLPVSGVKQQVHLACLCLQTDGPGPSLHPPVLGPQGSQFYQQSAGNRVPGQALPLTPCGFVPATRSAPPWVPPTPRSPARWTSGSWEKTVLCWGRFDS

SEQ ID NO: 781113 - protein, 175 aa, Homo sapiens
MGKITFYEDRAFQGRSYECTTDCPNLQPYFSRCNSIRVESGCWMIYERPNYQGHQYFLRRGEYPDYQQWMGLSDSIRSCCLIPPHSGAYRMKIYDRDELRGQMSELTDDCISVQDRFHLTEIHSLNVLEGSWILYEMPNYRGRQYLLRPGEYRRFLDWGAPNAKVGSLRRVMDLY

SEQ ID NO: 781114 - protein, 109 aa, Homo sapiens
SSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHLVC

SEQ ID NO: 781115 - protein, 84 aa, Homo sapiens
LDIFRQGRLWLWMGGSEGVHACAGTHIRERKRGRQASRMNVCFETLGSMSKEYNSTTQATRNRPHSLLELYGRVIRGWLVPDMC

SEQ ID NO: 781116 - protein, 72 aa, Homo sapiens
FSHGTWTSCLPERPPFWIPEDPARVVTAGSAGLEKALLGPGTAGGGRRIMPGPGQGVQGREWMHRYRPCSYV

SEQ ID NO: 781117 - protein, 70 aa, Homo sapiens
RVQIMTGKVRDTTEPTLTVVYTEELAGREAFHIQLGSGKGPHNIVATRGRAAPAGPLTRLKALFLGVKCL

SEQ ID NO: 781118 - protein, 372 aa, Homo sapiens [sequence omitted]

SEQ ID NO: 781119 - protein, 372 aa, Homo sapiens [sequence omitted]

SEQ ID NO: 781120 - protein, 372 aa, Homo sapiens [sequence omitted]

SEQ ID NO: 781121 - protein, 372 aa, Homo sapiens [sequence omitted]

SEQ ID NO: 781122 - protein, 37 aa, Homo sapiens
MCLLVTEEKCNLPDSVFQFLPCNCKASDSVNISISLC

SEQ ID NO: 781123 - protein, 123 aa, Homo sapiens
PHRGPGLEQNAAHSRRSNVSVIWSHLWEMDFPGAGAILGDGLPQSRQVPPQAVPGPAHQAAPLGFSEFTRQSIKHSGRRLWKPALSANGEKAGKKGALTRCPLHTVLMQSSHTTKRSSVYQPG

SEQ ID NO: 781124 - protein, 38 aa, Homo sapiens
MHSQVCSELPMRDLAVAKRQVPSRMQVSMGECQASSSP

SEQ ID NO: 781125 - protein, 91 aa, Homo sapiens
MLSATLTIPIWQWFLTRFGKKTAVYVGISSAVPFLILVALMESNLIITYAVAVAAGISVAAAFLLPWSMLADVIDDFHLKQPHFHGTEPIF

SEQ ID NO: 781126 - protein, 105 aa, Homo sapiens
DFLEVTDRIHILVGFIFIHSQYSQPVSFSVFPFSVNVVTSCQKTGSHPPFLSDASYQIKIACSASRISLISAHFSLCSATILVQVTTISLCNITIDYLLEVQFLI

SEQ ID NO: 781127 - protein, 105 aa, Homo sapiens; identical to SEQ ID NO: 781126

SEQ ID NO: 781128 - protein, 115 aa, Homo sapiens
MSTPACEEGRSQTSDVLKYHKRVKVNILWVEFLQDTSTNPIEVASDNCVCWKKKIQPGKGGARDKHLAQEPRAQKESRTLMLTHTCTHAHEHTNMHVYTLSHTRMHTHTYTCTHT

SEQ ID NO: 781129 - protein, 90 aa, Homo sapiens
CSTSFQLNPPLHQGKKDIFPASTDLWALLFQNGRWQNFIQKQSLVPTRKPRDTGEPLVATQVKHERLRNGNAVLHMAGSPGPAVGCSSVI

SEQ ID NO: 781130 - protein, 148 aa, Homo sapiens
AAPAVWWLLPGALRAEGLAMTLAPAAGSARPRAHPSVLRADPVQSPCWPGLRGFWQLPPCTPYPSPYQILLSGTFFPRGVGDQEHKGLLFAEYHMAPCVGARLGAVQTQFHPGLTHCPAVTEPLSASSSSSVKGCMLTSDVHCEGDTR

SEQ ID NO: 781131 - protein, 121 aa, Homo sapiens
VGEPPETGWGNWFVAVYPGINATFFSAVSAGPSVGGSNSFWPGLLTFLSGQALLDSFSQRCLSLCSVSLEGRSQSFTIGWIWFDIFWWTVKGERKFLDYFKIPHRPRPTDVCELRLWKLEC

SEQ ID NO: 781132 - protein, 78 aa, Homo sapiens
MRPTWRCGVSLPPNYKRNTAPGGSNTQSAVFVRTKFSEILESLSREGLNTAGRFILHPRRSPERRPPIIQIYARSVVW

SEQ ID NO: 781133 - protein, 290 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 781134 - protein, 210 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 781135 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 781136 - protein, 176 aa, Homo sapiens
MFDLYEDKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 781137 - protein, 361 aa, Homo sapiens
QAATGLSDQDPYPLDMASVPCKPQPRSPARLQTAKRHHHRACAVPLTRAQKATGPEAMETVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 781138 - protein, 183 aa, Homo sapiens [sequence omitted]

SEQ ID NO: 781139 - protein, 84 aa, Homo sapiens
MLPGSGERGSLQSRGKAWEAEAREEGARRGMKVQQGLMVNGGTVPLILSSPGCGVLLCFLPCPDFSVAKYTWPSFHMTKERPRM

SEQ ID NO: 781140 - protein, 122 aa, Homo sapiens [sequence omitted]

SEQ ID NO: 781141 - protein, 84 aa, Homo sapiens
MVVRATVAPVKESDKTLLELDLEDSLRCQEGQGGWEGILGGGNCQSIMGYKSGSFQPRPQEMPDLTFQRMGQTAGNIHQRGVRK

SEQ ID NO: 781142 - protein, 108 aa, Homo sapiens
FPLFSLVFIQLQKTSSFPFVKNSKALITAFKFSVQNTHTPNLPLKFLSQPHKEFSCNVNCELLVNRMQDRQRQGFGILSVLFRYWHEMGAFAHRRHSVNIRIGWRVTD

SEQ ID NO: 781143 - protein, 71 aa, Homo sapiens
FPIKAQVSLGLSNVSDEKKLPKVAEIEKPLLGVLTYSLGLSLLGGVFIEASRVLPHAMTRGRLKFVNSYGI

SEQ ID NO: 781144 - protein, 143 aa, Homo sapiens
HLSISKPFHCNSGLFPHSLSLKLMENWQVSIRLTKAFITVNKESSATRQNLWFSIQICFSCNLKQLGFPSFRKKGAVPAGSSKILRATEFHPQPNGSSLLLLSLGSKGKPIIAWSRERSKAHQHKVLEDIWTDRKRRKGMKTP

SEQ ID NO: 781145 - protein, 92 aa, Homo sapiens
TNALPIRAFQAALGDPAGRKPTGPPLISRDRWGHGSSSTSIPPLSGSQSCLGEVHHPICTLAAMDMATQPVVHGPPLTAGMDTQPTQVEREG

SEQ ID NO: 781146 - protein, 46 aa, Homo sapiens
MASTKLEKGYSEEERRVGEKRDCPEAPLITFNQQNKYFLEKVSAAL

SEQ ID NO: 781147 - protein, 110 aa, Homo sapiens
MAGLMNVRLRGKRMEPASTFCHSQSGVTSPCSPSCLQACRALPISAASAWLPLRTTTALSPSPTPILLRVQVSPAHPKPRCLPSPFSALGPQGKACDRRLPLPALVSSSS

SEQ ID NO: 781148 - protein, 86 aa, Homo sapiens
DACFQQQAHKTQRLFCLKQLKRIFTWILCVYMHVYVCVCACMCVCVWMDMCMCVYMYACGGLCVCTCVCVHLYRFTGSYGCVCVYT

SEQ ID NO: 781149 - protein, 53 aa, Homo sapiens
MASRYDRAITVFSPDGHLFQVEYAQEAVKKGSTAVGIRGLTSDARVINRARLE

SEQ ID NO: 781150 - protein, 87 aa, Homo sapiens
TTGRSDQTYARGWMKTLREDERRDPKPAQQGELERDPVRKVGSQEGLFHLQTWTQNAHARDAGMWPGRRMLGNRNMKASLCGGVGFK

SEQ ID NO: 781151 - protein, 64 aa, Homo sapiens
PVCSAGRGVDRAAEEAPDSKERRQPVRTPLHPGPRQGTSGLHCELLWLSPASIPALSWQLHHGP

SEQ ID NO: 781152 - protein, 103 aa, Homo sapiens
NKSRTTMRTKKKATYLAPCLATETLVCDPGSPSLGAANTVVILCGGAVLCVRQCLAVSLASRPCSTPSFCDQKYFQTLPTVPGGQGHQVKCGPSIAFESQVNK

SEQ ID NO: 781153 - protein, 48 aa, Homo sapiens
FIGGYIATSRNTGIPFTKKGGNEEKRRQPGVHATESYSVTPLLCDLEE

SEQ ID NO: 781154 - protein, 196 aa, Homo sapiens
NCKNVSLVHLPLCLLKDTRVRRANGPIKWPGLCPLFLTPQWAHCPLFLNLQWAHCLLFLTPQWAHSLCLGMLLLLWLPLLWLLLILSFFSSFCCSGQVCCSAAVVWSAVLLQWSGLLSCCSGQVCCSVFCCSGLVCCPAAVVGSAVLLQWLGLLFCCSGRICCSVSCCSGQVCCSVFCCSGRVCCSAAVVRSAVLL

SEQ ID NO: 781155 - protein, 131 aa, Homo sapiens
PTVNLIQSCLNSCVFPIVLAGIPSPKGRAQAPLGLVPVCVSILLVLPLLPDLSCLLHTLHILIVQILCFWLSDSSRCSVCFSFFLLTFSGYFLPSPLALGWYSSPSVTFFPILAKAGLQVHTSVAPSLSIA

SEQ ID NO: 781156 - protein, 44 aa, Homo sapiens
KLGTGMKMDWEEISPRRVYKLRGKGPSHPADPPSQLASGTFSKP

SEQ ID NO: 781157 - protein, 246 aa, Homo sapiens
ETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 781158 - protein, 102 aa, Homo sapiens
MHFCLGVCNQTSERTGNVPYIKVISTHFGKGGKTEGQCHHYSLSQRKHELMYTVVSRTGALKSVCRLGESHCRPSQQPPRKVTPKVVPALNIKVCLCRGLIW

SEQ ID NO: 781159 - protein, 61 aa, Homo sapiens
ICLVTLHCVLSSVCKVHPLKKASQESSCFNPERSPHFCLPHMKLSYVTEYHRNLEVGASNE

SEQ ID NO: 781160 - protein, 54 aa, Homo sapiens
FEDHHQTFLLSLDTTASSPHTSLAATETCSQEILNHALSQSYQNGRGISQEKLS

SEQ ID NO: 781161 - protein, 43 aa, Homo sapiens
MVQAFNFKIPKTWGNEFGGRAPVKIPVSLFLYILSPSPISYSQ

SEQ ID NO: 781162 - protein, 66 aa, Homo sapiens
KWLRCRVNVVIGHCEKETEELTAIPQMASRCRVDSGCCNQKECWLPAAISWLPAEVSLFWSGGILF

SEQ ID NO: 781163 - protein, 162 aa, Homo sapiens
MQGWFNIHKSINVIQHINRTKDKNHMIISIDAQKAFDKIQQHFMLKTLNKFGIDGTYLKIIKAIYDKPTANIILNGQKLEAFPLKTGTRQGCPLSPLLFNIVLEVLAREIRQEKEMKGIQLGKEEVKLSLFADNMIVYLENPIVSAQNLLKLISNFSKVSGY

SEQ ID NO: 781164 - protein, 103 aa, Homo sapiens
TGPPSEEECHFCMGCTTPDRTTEHTHWAVAQGHPPRGRIEPGAAVCSQPQTPGNAASHTVLKVDGWLSDFSGSILPLPDISKTSSPPCFLSSNSSQHPLSCAN

SEQ ID NO: 781165 - protein, 125 aa, Homo sapiens
TLPPPPQQPPKRGDWEGYTKPSSLNPKFRRKWAGADGLQTGKPRLRTLHKVTVFVAKPRGTGSVLSATPQGSTSPPDSPYQSSPSLLRSAWDKHISPETEESLQARYPGMAQSLLRPARHDGVQG

SEQ ID NO: 781166 - protein, 97 aa, Homo sapiens
ARAALAHLAASPQGARTQTCPCHLSARVRAGGGGATKGGAESGAQDSAGAPAHRGAHRPRICEEVTQISRQCWMQTDLPAIASLSKPALPVSSEDTK

SEQ ID NO: 781167 - protein, 97 aa, Homo sapiens; identical to SEQ ID NO: 781166

SEQ ID NO: 781168 - protein, 112 aa, Homo sapiens
MPQHGGTFPKADWLRPREACLSCAGCRPFFLHCTSLPWHESFPFLPGAVVFLHWRLWALAPVVEDFRRLWCFPSLCLGKGSFLTALPHGIPSPSPSSSLPFPPPSSPLTLIP

SEQ ID NO: 781169 - protein, 67 aa, Homo sapiens
MGPQEGPSLIAKNSSLFLPRIILAAKVLELLQLICKTFDPICLKTSAFSVGLSGPDQGSPSTHPQTH

SEQ ID NO: 781170 - protein, 255 aa, Homo sapiens
LDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDIT

SEQ ID NO: 781171 - protein, 156 aa, Homo sapiens
MVVAHPTATATTTPTATVTATVVMTTATMDLRDWLFLCYGLIAFLTEVIDSTTCPSVCRCDNGFIYCNDRGLTSIPADIPDDATSLYLQNNQINNAGIPQDLKTKVNVQVIYLYENDLDEFPINLPRSLRELHLQDNNVRTIARDSFVPHFPHVGE

SEQ ID NO: 781172 - protein, 137 aa, Homo sapiens
KAPQSLYVPSSLSFLPLTLLKYPGEVLSFGENIAIGNIANICYRKISQTWQFRHNMCFSPLLILGSPRSRHDTEAQLAALLRDLTLLLPGGPAPAALPSCLHAPQPVAHVERFGVWGWKISVQILHSLPCASVSLAS

SEQ ID NO: 781173 - protein, 85 aa, Homo sapiens
AIASRCLARVPGCAYSSIMVALSLVPLCAHMPTPSGLEVALPGNRTICWLSLWPSWQLDEDAQSPALESSSIRQFPTAPRSGISP

SEQ ID NO: 781174 - protein, 153 aa, Homo sapiens
MKWETKRATSLVTCRWRRGALRPFLTYPLSRYGGCPKHSVMGTGLGTATLGTSARGWGVSCRRGCRAGGGLAIPSTGCIIKKSLRQAGRAECELTLRAGGDTAMALPLPLLPRGKIPPANIIMEKHKHRNLVSANNVPQCPGPAWPSAQRAGW

SEQ ID NO: 781175 - protein, 41 aa, Homo sapiens
TLEDLLEAGHCTPPHSQDFGQSWPAPETHSWELPSPEGKRL

SEQ ID NO: 781176 - protein, 116 aa, Homo sapiens
MWEGFNSAGVDCSNPARSQEGPLAGSWELSSCSVLTDERDWSHVALLCLVVDQQVMDGKHLLSLWVAGTSLTDPQVQESLPGPHHGTSCPSFLLEESGAPCVTPLGGTLEAPGFPG

SEQ ID NO: 781177 - protein, 148 aa, Homo sapiens
LIQQPLCYIMNFFLKANICFPIPKNRMIFSSKWKRFLHSSLLILSNGFLKYPPVGNMMWHTHRLPMCMGHTRGGPSARLIDTAVSPLWLHSCGKAGVGSVTSQVGLTPVGREPETFPCVGTLLTGSHKPRCPHAASTPRAPRRKFVIF

SEQ ID NO: 781178 - protein, 80 aa, Homo sapiens
NNVIFMDTGDKDFHIFWGDTIQLITPIILEPYLPSVHLCLRPAASQEKSLCLVCHSCLPCRFQRRSHLLERPSLATLNIE

SEQ ID NO: 781179 - protein, 89 aa, Homo sapiens
DSSLKCQAGCPFPKYAALGSCPGLGRHAVSTCEGLRKGNFTSARGLTGHVSLGTNLLGYEVRSCRCAVVSPCPLRVIPIKCEKGQAGCS

SEQ ID NO: 781180 - protein, 108 aa, Homo sapiens
GLALLPRLECSGMITAHCSLDLLGSEDPPTSASQIARTRGAHQHAQQIFKSFCRDEVLLCCPGWSRTPGLERSSHLGLPKHWDYRREPLRPADFSLTPRFQPEPGRHS

SEQ ID NO: 781181 - protein, 89 aa, Homo sapiens
GGMSGYVIELSRAWGLEVVCRMYIQVSTQVSTDLCDKIIKEMKIRVTAICQNISRCQSLKYEQQQLMWNDKDEVRAVAIRHLLNLMSTV

SEQ ID NO: 781182 - protein, 103 aa, Homo sapiens
PFRPCLGPWIPARCPWTSPVLLHGDRNKHRAVVRLSILCPSSSSTKWSSSQASEGLSLSCRVSERTVGSNAQVPRQCLTCAGGWPCLLPIRSPLNYPSAVNGL

SEQ ID NO: 781183 - protein, 105 aa, Homo sapiens
GWRESERRVATQSCLGPGLRLGGECHSLYLTADVAQAFLPGTPGDSGVNIDSVSASACWPYLPSLQGGCSRALAMWWEPVFQQQPKAGRPDCGVRGQLCMGATLQ

SEQ ID NO: 781184 - protein, 67 aa, Homo sapiens
SAAALPLTWTTATASYRGSPFPFLSPIVHSTQQVDVSLNVNQIKSPLLTIFQWFPLTFKLTSKSHII

SEQ ID NO: 781185 - protein, 110 aa, Homo sapiens [sequence omitted]

SEQ ID NO: 781186 - protein, 110 aa, Homo sapiens
SPYELTRKAVKQDYELSGRPVEWIIYELSRSPVEWIIYELSGRPVERIIYELSGRPVEWIIYELSRSPVEWIIYELSGRPVERIIYELSGRPVEWIIYKLSRRPVEQIHL

SEQ ID NO: 781187 - protein, 57 aa, Homo sapiens
HSVCWGTQKMKQTGSLPQRAHPHKCPQGLGRSSLEGSQPGSEPGELEKTAALVVDIL

SEQ ID NO: 781188 - protein, 115 aa, Homo sapiens
CILKFIQNLKGPQIAKIILKRKKTVRGLTFPYFKTYYKAIVFKIVWYWHKDRHTEQLNRIKCPEINPCIYSQLIFIQGHKDYSVKKGQPLQQMELEKLDIHMQKNRVIPFILHHK

SEQ ID NO: 781189 - protein, 121 aa, Homo sapiens
SCLGKTGASLRSGWSVSLVWLLLYTSTNNRGQVYRGGTTTLGVPIPGLRANQMTTRLAVHILQERCLFHFTTNHIESLSKGQTQITPAVAVLWDAEVGGLLEARSSGPAWATEQDPVPTKR

SEQ ID NO: 781190 - protein, 103 aa, Homo sapiens
VSVSGRSPALSPRLECSGTISAHCSLRLPDSKDSPASSCQVAGITGTCHHAWLIFVFLVETGFPHVGQAGLKLLTSSDLPTSASQSAGITGMSHHTQLEIIFE

SEQ ID NO: 781191 - protein, 137 aa, Homo sapiens
TVPDHSPVSLSNPRNSRTESSGHPSSFYHKTLGSTNYLTLNLQLLLQQQASSLSNITSKLRNLPLTIHPIGSEMDLAFLVWPPVAPWLYPFWVPTPGDQAYTHKTQPVISKMHKATTEIICGSCWRELKKLGMLQSS

SEQ ID NO: 781192 - protein, 50 aa, Homo sapiens
FRWARITPPNKLSLRSPVTSVYNVLVPVSISVLVPVFIDLSAAFDTVDHT

SEQ ID NO: 781193 - protein, 35 aa, Homo sapiens
AGNITLKTSLGANTGGQECDEVHTVPESKVSLRNH

SEQ ID NO: 781194 - protein, 70 aa, Homo sapiens
SEGGTETPGKKAETQRREETEETQGDRDSEREKDRDPGNTHPEGGIKTKYGDRDPEKREDRKPAGEEGEM

SEQ ID NO: 781195 - protein, 275 aa, Homo sapiens
PRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTT

SEQ ID NO: 781196 - protein, 47 aa, Homo sapiens
STEEVDSTDEEVEAHQDGAPRVTWWPLLVTSLIHPPAFQGGSSWEPP

SEQ ID NO: 781197 - protein, 34 aa, Homo sapiens
ESSVEENEKQQNASESKLELRNNSNTCNIENELE

SEQ ID NO: 781198 - protein, 66 aa, Homo sapiens
DYYYEICRPRRHHTCLLYLEVVFPIPTWLTSSLHSSLCSDINLFREPFLHTLSCIAASPTSCLLSP

SEQ ID NO: 781199 - protein, 130 aa, Homo sapiens
MTAPPLRAAALTQREAARRSPQVPIQGEPQTCCVRPADSAAGSAEGSGAGAELRSPGSGQDREPSPPEAQRAAAVRAVSQWTPSPVLNSLGVLGTYSVRTQLWEEFGRCGHRPQCPSPRESRGVNDDSPV

SEQ ID NO: 781200 - protein, 107 aa, Homo sapiens
TAIPEEMVNSHAVFGEGSSQECTLHGGQGWLRQAWGELSLDGELSAVRSTSSSPARGHFRAVRQNSLGTVHESLGEKAGPSLCDVKHLCRTQGHIPFEPQEQTGKQI

SEQ ID NO: 781201 - protein, 98 aa, Homo sapiens
NNHARDAGCSEDFPPVTAKRRIQMTDNVRLFLGRAPSLYRQRAQQHLQPEPEDPSPDLEMRGRKRRPRGARVEAPWSLGGVESWGRCRKGSSGEAGTF

SEQ ID NO: 781202 - protein, 92 aa, Homo sapiens
VLLLGGTTGARFPGSQVTGTACQPPASLSSPAISHTPGSEEQDSEPESPAPFLHRASPVPGLDLFKNHSFVFKEEQKRHQQKQQGAFGFTKR

SEQ ID NO: 781203 - protein, 120 aa, Homo sapiens
SPYTGQKKVPLSSIFYVTQHFCLSFQLLVLSSRLSASFTWSPHTFLRTWIWHGFLTLLQTSCPPSTDLLHSLPDLTPSLREIITSFLHPSLTQSAKQTRARVHPALYHPLFSNNASPSST

SEQ ID NO: 781204 - protein, 58 aa, Homo sapiens
MDEDIGVGTGFDPRPQAAASVLYQPCGVLTVPYQETQSTRGFRSSLLPPLPPGEKDPR

SEQ ID NO: 781205 - protein, 66 aa, Homo sapiens
TGISGGWSMLNALQGKEDETGRRWEEKLLSGVAKRATLQPFFPGTIFRAKTENALKLLVPNGVNPG

SEQ ID NO: 781206 - protein, 126 aa, Homo sapiens
HEKRERGDSHVSYKEMPEKDKKGMTERSGGNKSQDTETKKDKPQTGEKGPERMAERNSEGDRVPRLGQRQNKASPTQVREAHGAQGEPSRAPALRRAGVQAQLRASLPFSLAFWETLSPLPNLPWC

SEQ ID NO: 781207 - protein, 257 aa, Homo sapiens
LRIPPPGTLRGSRTAAVLALLSLSLSMYLVTVLRNLLSILAVRSDSPLHTPIYFFLSNLCWADIGFTSATVPKMIVDMQSHSRVISHAGCLTQMSFLVLFACIEGMLLTVMAYDCFVAICHPLHYPVIVNPHLCVFFVLVSFFLSLLDSQLHSWIVLQFTIIKNVEISNFVCDPSQLLKFACSDSIINSIFIYFHSTMFGFLPISGILLSYYKIIPSILRISSSDGKYKAFSTCGSHLAVVCWFYGTDIGMYLTSAV

SEQ ID NO: 781208 - protein, 78 aa, Homo sapiens
KWVAMKSYQWRLKENQEGPEREWSQEAGRREAGFVSGLPRAPRRGASLLSMAEHRGWNTDVRSSSGPERKNSLVPGLL

SEQ ID NO: 781209 - protein, 126 aa, Homo sapiens
VFLQRLPKPSWNSLFESLRGDRETGGGGVLEAFLTGAWRGHVGQGEAQGPLVTLGKPPSSLTLTSVLICQGSGWVTSKNSEAEAGVARVLRPASVSPSASPRFLKALPALKTNQPPAGGLGLGQAA

SEQ ID NO: 781210 - protein, 46 aa, Homo sapiens
RGLPSTGGSRRPWLAEKQGGGKEGGGPEGRSDRSAETSSPPSPAPT

SEQ ID NO: 781211 - protein, 346 aa, Homo sapiens
AAANSARAESNMAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 781212 - protein, 296 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEENNPKGRSSKYGLLHCGNTEKDGKSPLTAHDARHTKAICL

SEQ ID NO: 781213 - protein, 228 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 781214 - protein, 107 aa, Homo sapiens
PRSAPEVYAFETTEWPGSRSQRILACVIQNFMPEVISVQCLHNEVQLPDDRHSTTQPRKTKGSGLFVFIRLEVTRPNGIRKMSSCPVQSMRQRSPHSLSSDRCRKSR

SEQ ID NO: 781215 - protein, 274 aa, Homo sapiens [sequence omitted]

SEQ ID NO: 781216 - protein, 109 aa, Homo sapiens [sequence omitted]

SEQ ID NO: 781217 - protein, 346 aa, Homo sapiens; identical to SEQ ID NO: 781211

SEQ ID NO: 781218 - protein, 340 aa, Homo sapiens
AGWYGPKGRSSCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 781219 - protein, 256 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTEKDGKSPLTAHDARHTKAICL

SEQ ID NO: 781220 - protein, 212 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSITISYT

SEQ ID NO: 781221 - protein, 112 aa, Homo sapiens
ACPPCKDSSGSMRVPHTAPISWMSPAGAGGHPGLLAAAPSQPGLAQPTAWEVTGHSPRSWDPRDAGPQCGAAPMMRSWPPTLRAAPGTNSVFVSVCFSKKWFKLLLRFLNLL

SEQ ID NO: 781222 - protein, 103 aa, Homo sapiens [sequence omitted]

SEQ ID NO: 781223 - protein, 83 aa, Homo sapiens
YHPPGLLTGLLLPLLPIEFVLHIREILLKPVTSLLKNPPCLSTALKARSHVALQDLAPGDVSDLIPTTGLLYSGHTGQTCASQ

SEQ ID NO: 781224 - protein, 94 aa, Homo sapiens
AAEPFNEQGSLQFTMAQPGLFHSLRYLSGLQGAEILTVGHPLVPLGQKPAASKEEEKRVLLLELVENTVPKTSMGPSHSSSPLLLVLPGPLSHS

SEQ ID NO: 781225 - protein, 64 aa, Homo sapiens
VQVPAGAPHRLPDATMPPADGTEMRPWKLSPRPRAPSDQPHPLDFKLGALCHQEAPSPPPLKEL

SEQ ID NO: 781226 - protein, 55 aa, Homo sapiens
PEDLGCLPGAVGPGDPPRHLLLPAQLQVLSSSRANLSWEIKCQVGTQLVTAGSGT

SEQ ID NO: 781227 - protein, 91 aa, Homo sapiens
MASSQNSMQIILRPVPPAQTSLNSHLHDSKVFQAHHGKDQIRDLSQTNLIVFLCCYLMEWPNYPSMQQKQKVQALSFVPLLHSILPCSPLL

SEQ ID NO: 781228 - protein, 80 aa, Homo sapiens
NPGLSDPNASNSHLGDGKGPPQAPAMSTPPAWHSGCILPWLPCVHRKAQLHAQQPSFLQPPGHLWFPAALGSFQPPGLCP

SEQ ID NO: 781229 - protein, 123 aa, Homo sapiens [sequence omitted]

SEQ ID NO: 781230 - protein, 141 aa, Homo sapiens
MIKGLAQHKDTIILNLYATNTGAPRFIKQLLLDLRNETGNNTIIVWDFNTPLTALERSRQKVNKETTNLNYILEQMNLTGVYTTFFPTTAEYTFSSSAHGTVSKIGDMMGHKISLNKFKKIKILSSIFSDHSGIKLEINYK

SEQ ID NO: 781231 - protein, 186 aa, Homo sapiens
QRCLGQQRVLTRLEMRQSGSESSLVNVSESIAVSGTSSSTNPWGRWCDIIQPAYSQQKAREEEECKKVLTSSCGAEVNDANRCVERLNSYLTDIHRDKSSTILILNLKESLIQKVQCRVINLRDEKESCEEMMQQGERIGTTGSGSTRVMWKIRELLFLECSYSEGRPKQKRHRCRTPSKLDGVLG

SEQ ID NO: 781232 - protein, 68 aa, Homo sapiens
NRADTNSPRWVVPAASSSSALHQSFILATEFPPSLLYRHPIPMAITNTIITKPNSSSGFICPKFLLHI

SEQ ID NO: 781233 - protein, 82 aa, Homo sapiens
MGCAHTQLNKLHHFIITSKISEEGKEEDSTSYCNIKGNGGTWKCLSTWNSCQKGSTFLASHPIYVMQLQLRAEGDLLGAAGG

SEQ ID NO: 781234 - protein, 32 aa, Homo sapiens
MVMLPAAKLTPMVVMGPWSSFGLSPFSQLFTS

SEQ ID NO: 781235 - protein, 49 aa, Homo sapiens
MPRDVAKMAGGALWEAECMVPSPKGLDAETSGEQVSFYGEGNSVVRSGK

SEQ ID NO: 781236 - protein, 49 aa, Homo sapiens
MHLLRGWSCAVPCCLAHTGGCWRCFLVNAAGPHHVLGSEGVQLSPPRLG

SEQ ID NO: 781237 - protein, 78 aa, Homo sapiens
MGVLLTKGHPHQTLGPAAVAPPGSFSYGGQKEEEEPLSGNGCLCSLCGGRAPVLDCVRVHPKAPGPSEFQAGISNDND

SEQ ID NO: 781238 - protein, 104 aa, Homo sapiens
VSEDTWEGLTPPAQKAPGFPSPLWPLLGLPSPGLPHYPAPANAPSKIPQGAGTAGTPSQATQEIGQAEKELRRGWKGRTGKQQRRGSGPWGKTGREGLSGSNAR

SEQ ID NO: 781239 - protein, 121 aa, Homo sapiens
PRHHCEGCGSPMTLEEGGAGTVYSALVGQEMLLPLLKERRGRIRMPGARVSVHGSPGTRRESGRMRARRRRLRPEAPQPKCADFYSSVALMLLLGLFFPLLLFCDPLLLPLPLSLSSSLFN

SEQ ID NO: 781240 - protein, 39 aa, Homo sapiens
GQGQKVQKVMVQPISLIFRYLQNRSRIQVWLYEQVNMRI

SEQ ID NO: 781241 - protein, 111 aa, Homo sapiens
HHHHHPVTITTTITTATIITTTTSITSITTITTTIVTTIIITTTAATATTTIIYHITTITPITITTITTIITTTPIATTITTIITTTTAFTITTTTTITITVVEEVCLKLC

SEQ ID NO: 781242 - protein, 240 aa, Homo sapiens
RFACLTPGSGLRSLATPPCLGPHSHCSLAGKDMEPNGPSLPRDEGPPTPSSATKVPPAEYRLCNGSDKECVSPTARVTKKETLKVSPGPGRVQQCHCQTDGHLSQGGHPPHLSKGGDKPHLVASTPPTSSYFLSCPCPWTHPWAGRWEELGQLGAFSHDPPRVPRAQAQKENYRQEKKRATRQLLSALTDPSVVIMADSLKVGDARPPATQDTGQRAAAITKDHKPGGLKRWKFTSLHLA

SEQ ID NO: 781243 - protein, 879 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 781244 - protein, 863 aa, Homo sapiens
RFACLTPGSGLRSLATPPCLGPHSHCSLAGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 781245 - protein, 418 aa, Homo sapiens
MPYAHCKGILYGTMILELAGKVTIEYAKNDFQAQLEFQRKPLLYGGSTSINQISGKITRERNSWRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 781246 - protein, 879 aa, Homo sapiens; identical to SEQ ID NO: 781243

SEQ ID NO: 781247 - protein, 101 aa, Homo sapiens
ARERQESLMPWKPQLFHLDPITQEWPFFGGSTSINQISGKITSGEEVLASLSGHWDRDVFIKEEGSGSSALFWTPSGEVRRQRLRQHTVPLEEQTELESER

SEQ ID NO: 781248 - protein, 51 aa, Homo sapiens
MRPGDQIWPLVLHVKHTVGCKEVASRSPQPLTQLLSRRDNSGCSPGVAEEQ

SEQ ID NO: 781249 - protein, 879 aa, Homo sapiens; identical to SEQ ID NO: 781243

SEQ ID NO: 781250 - protein, 865 aa, Homo sapiens
EEGGHREKRRRRKASRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 781251 - protein, 879 aa, Homo sapiens; identical to SEQ ID NO: 781243

SEQ ID NO: 781252 - protein, 879 aa, Homo sapiens; identical to SEQ ID NO: 781243

SEQ ID NO: 781253 - protein, 879 aa, Homo sapiens; identical to SEQ ID NO: 781243

SEQ ID NO: 781254 - protein, 51 aa, Homo sapiens
MPGIPCSVSALQLKIWAMGLYGPAAGEGYRGMAAYQDQVHVIFLGIVTTDG

SEQ ID NO: 781255 - protein, 194 aa, Homo sapiens
AAAPTSGAPAMARSLVHDTVFYCLSVYQVKISPTPQLGAASSAEGHVGQGAPGLMGNMNPEGGVNHENGMNRDGGMIPEGGGGNQEPRQQPQPPPEEPAQAAMEGPQPENMQPRTRRTKFTLLQVEELESVFRHTQYPDVPTRRELAENLGVTEDKVRVWFKNKRARCRRHQRELMLANELRADPDDCVYIVVD

SEQ ID NO: 781256 - protein, 115 aa, Homo sapiens
KEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNC

SEQ ID NO: 781257 - protein, 70 aa, Homo sapiens
GPVCGSDTLPGSLVRVSSTSGAGAVFCMRVCRTWSRWCYDKRLWPRMDLSRRKSLTPPMLSGVVRRQPRA

SEQ ID NO: 781258 - protein, 51 aa, Homo sapiens
GPLCFCASEFLLVSVTDCWASVSSSVTQQKKTQVRAPWGSRSSGAGERPVA

SEQ ID NO: 781259 - protein, 68 aa, Homo sapiens
LLGQVEMKIAAIRAFSLLLLLLLLLLLLLLLRWSRGVGAHSPDAAEKLGRSTYQEWELAIQRKKMKLA

SEQ ID NO: 781260 - protein, 124 aa, Homo sapiens
MKFPNSWPSLKISCTFGGVSCRLPRSGPVTPVPSSLPHWHSGLWVFTHLGQNEEWPKVESGGDPSLLACPGPNQSVQYPFGGCDNLPFWEGSCPPLQSVALLSFCPNLDPGNLPVRKPDNSFPV

SEQ ID NO: 781261 - protein, 66 aa, Homo sapiens
KTQRQSIEKEQWAQGTGTLSVGGPALVPVSGFPQYLLMIIFTILARGVQQENRENGDGGEKVRRKT

SEQ ID NO: 781262 - protein, 159 aa, Homo sapiens [sequence omitted]

SEQ ID NO: 781263 - protein, 120 aa, Homo sapiens
PEEFSLTQWSSAEGNLAFPQRDTWQYLHTFLVVTTGKSLYHHKAKRPFLLPREKIKSRSSWVLWSDRIFVSPQNSYVEIQLPEVVVLRGEAFWRRGGHEGRALINRTNTLLKEAQERPLE

SEQ ID NO: 781264 - protein, 137 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKW

SEQ ID NO: 781265 - protein, 80 aa, Homo sapiens
MEEKQQIILANQDGGTVAGAAPTFFVILKQPGNGKTDQGILVTNQDAWTRGALRSPSSFLTTQAVLLQDIVQGTSPPRVP

SEQ ID NO: 781266 - protein, 111 aa, Homo sapiens
MEHTSTYKSYMTNAQLTSYQMGKNRKTFPPRTGTSQECPLSPLLFNTVLEVLVRAIRKEKERKTIQTGKLEVKLSFFDNDMILYLEKPIGSTKNLLDLINKFSRVEYKINI

SEQ ID NO: 781267 - protein, 251 aa, Homo sapiens
TGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 781268 - protein, 104 aa, Homo sapiens
CETFHLLGHFPTDIQLKTTVGKANLAIRHCRSWLGNKICLSPNSPEKPFSIYIQQKPKARSPKRGPTSSFQSNPSSINVSDRTPKHRQQKKKIAKQDTSKIKIF

SEQ ID NO: 781269 - protein, 81 aa, Homo sapiens
SFYRCLVSWDRRSEAEPAGLGAPVNTGTDGGGQDDEDVWFGPPRWDLEEGREKGTEVGKRTALPADMVSLKCHPGPSAQKS

SEQ ID NO: 781270 - protein, 140 aa, Homo sapiens
TVAYYMTLGNLLDFVFLIEKNSLFFLPTKTQKRYLTFLSPNFLIFKMRITLMPHRVMKELRLGSSMYAWYISKQSINIAVFLFYFFLRQSLALLPRLECSGAILAHCNICLPGSSDSHASASQVAGIIGMHHHARIIFVF

SEQ ID NO: 781271 - protein, 41 aa, Homo sapiens
PKESTLTIPHLKYKLHLEVPRQDNKSLVRNIGGAQYMGNTE

SEQ ID NO: 781272 - protein, 125 aa, Homo sapiens
LRATGSWTLLSFPYLFQRLEGPLPGLPEADHEEPRFLGEMFSPEPIMRGDLVSVSYLSPTSHSSPVLFPSPPEGGQPCHDNSCQCHTARKPKWPLASFSLACLGLCCPGKDSRHLWAVSCSWSLL

SEQ ID NO: 781273 - protein, 64 aa, Homo sapiens
QGIRIPPQSGPSPPPCLTPNPRSSCNLHGSLKALSGHHAFAYAVPGPGSTLCQPALSTRLIALP

SEQ ID NO: 781274 - protein, 77 aa, Homo sapiens
RPPPQDQRLKAIGLFASLSSALVGWKSATQDSCCPLQESVHHKPGMSAELNGESKTGTNHFNYLRPKPNSQYFFTRP

SEQ ID NO: 781275 - protein, 35 aa, Homo sapiens
MRQAVSGINLLDLHSCSANQRMPPPASNSPTPGYN

SEQ ID NO: 781276 - protein, 102 aa, Homo sapiens
QSVKTSNPKQLYSSGWTAFSFHVPNYFLPHSKTVGDWCGALVLHKTLWVTSQMGVLQRGGLHSQTPWKNLLHWVSPPHSSADKGQRPTPTGLCPLVTESHSI

SEQ ID NO: 781277 - protein, 71 aa, Homo sapiens
APHPDTHMQSYMAPILFLWLQPNCSPHPPVHLLCAQHPQTQAPRARLTEASARQSEEDNHSNKPDTLKVRA

SEQ ID NO: 781278 - protein, 70 aa, Homo sapiens
HVPGYPYAQSLPEDTLWFHKNTLPPHNPSPVHAGDCQHCFQTRASRNKPKHSDFSLRNSGTPVVLSLTSR

SEQ ID NO: 781279 - protein, 152 aa, Homo sapiens
MYLTEKEQNERDDDIKNNRATERHITQNTMTIPRRTHTNGETRMEETESQEKTSTHERTQLKQYENDNIIHIEQRHGHHTRPSQHNQERLKNTQETWELQRKTQANADRQQKQTMREHKRPHTENHTGEDHREIPNTASTSAKRKRKEEREK

SEQ ID NO: 781280 - protein, 85 aa, Homo sapiens
MARGRQERQPPSPLPLCATKANIQGVITQKDTRTSSVARPQPSSAQSPRQPSTASPRWAFSFSSNATSSRKPSLTTELLLLVPAL

SEQ ID NO: 781281 - protein, 116 aa, Homo sapiens
FSYWMSIQVQQGILLIVTTPTMADRRFLSAHASTVAHCQGNVADCSLALRAPARNGKLSLAYISLAKETEWPSLSMALLPCAHNGRCVCEQPSDRHRILNFFSHCHSFEAQVPKNH

SEQ ID NO: 781282 - protein, 69 aa, Homo sapiens
IARLTEGMSCRKIAQLAVSWQATAYASKDGVLTEAMMDACVQDFVQQHQQMMRWLKGERPGPEDEQPSS

SEQ ID NO: 781283 - protein, 283 aa, Homo sapiens
RTFFIDASNQSLTAIPLEIFTFTELEEVHLENNQIEEIPQEIQRLKNIRVLYLDKNNLRSLCPALGLLSSLESLDLSYNPIFSSSLVVVSFLHALRELRLYQTDLKEIPVVIFKNLHHLELLGLTGNHLKCLPKEIVNQTKLREIYLKRNQFEVFPQELCVLYTLEIIDLDENKIGAIPEEIGHLTGLQKFYMASNNLPVLPASLCQCSQLSVLDLSHNLLHSIPKSFAELRKMTEIGLSGNRLEKVPRLICRWTSLHLLYLGNTGLHRLRGSFRCLVNLRFL

SEQ ID NO: 781284 - protein, 38 aa, Homo sapiens
QCGPPELKRASPVSGIISVCYHIWLLVVFFMEKDFAML

SEQ ID NO: 781285 - protein, 71 aa, Homo sapiens
PGRLYGWLDPEERQQSLQFSSQEATPIGKGGEYYIKGTPRGAKESEQQPLALDLPSDRAYPNEKEPENQPW

SEQ ID NO: 781286 - protein, 70 aa, Homo sapiens
IGEGSASHPHLPLFPGSSLLQTQSSWETSTRAVQKENTDLEPPHRATTLQTPDLETHQQLAPSVWKSYRH

SEQ ID NO: 781287 - protein, 51 aa, Homo sapiens
EASSRAQAGGQCQQLQGSRSDSAQLGPCVSAESTSPTQQLKGERRGGREQT

SEQ ID NO: 781288 - protein, 117 aa, Homo sapiens
CPPHLPVLAPSPCTGLWSPSCVYPHCPHGLLYSVCQVAAAPATLTGALFLPIPTLAAPAPLPLVSTLLVSCGCHNKLPQTGKHETTEIYSLTVLKAKSWQLRYGQGWFLLGTLSGNL

SEQ ID NO: 781289 - protein, 131 aa, Homo sapiens
RSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEYGA

SEQ ID NO: 781290 - protein, 114 aa, Homo sapiens
MRVSVELFDGDSQCSSLDQFKSKLQNLSYTEILKIRQSERMNQEDFQSRPILELKEKIQPEILELIKQQRLNRLVEGTCFRKLNARRRQHKFGIVGFRQSQVLHYELEESLRRT

SEQ ID NO: 781291 - protein, 73 aa, Homo sapiens
CQKRQHAPEADWHPEPKISNGQEEAGEGLRCFKEEATQIVDKSRDFLYFCHQKTHSGLAYLSRFLKNRQKRIN

SEQ ID NO: 781292 - protein, 103 aa, Homo sapiens
MYVGMMCTAKKCGIRFQPPAIILIYESEIKGKIRQRIMPVRNFSKFSDCTRAAEQLKNNPRHKSYLEQVSLRQLEKLFSFLRGYLSGQSLAETMGTNSTGNNH

SEQ ID NO: 781293 - protein, 103 aa, Homo sapiens; identical to SEQ ID NO: 781292

SEQ ID NO: 781294 - protein, 71 aa, Homo sapiens
HAVMSCECPKFDRAATPLMDLTPRITAGHSAASYFVRLRCLTRTCICPPNWTLAFLWAMSFSHTSSHPSGW

SEQ ID NO: 781295 - protein, 34 aa, Homo sapiens
EELCVCGDCCGVESSVSVKSSVVWRPLCMWRALW

SEQ ID NO: 781296 - protein, 105 aa, Homo sapiens
PADFERRGMLAWWQPRAARLWVCVGRGGWGCVCVCVCVYAHALTLGRGEGDRPKWKWGKESKVQTLRAATYLSSVILCSPYGRLNNDPQRCPQPNPQHLRICYLP

SEQ ID NO: 781297 - protein, 115 aa, Homo sapiens
PQGLTGLTAIPVLHSKQWDKARGMNQKLHTPSLLTLTGQSHGHTWLHKMLKNVTCIQPAMCPAKIFYSGRRGRQVLEDNQQSLPPPRLSFSNRSSPIWQKYRSLDLETKLNNGLL

SEQ ID NO: 781298 - protein, 47 aa, Homo sapiens
MSGTRTNALVYEKFCGFKDVCHLNIDHHGQCHPFIEWTAYGILGHEL

SEQ ID NO: 781299 - protein, 82 aa, Homo sapiens
MLTVLEEEAVFTKNLANIEVSETDTIKLVCEVSKPGAEVIWYKGDEEIIETGRYEILTEGRKRILVIQNAHLEDAGNYNCRL

SEQ ID NO: 781300 - protein, 115 aa, Homo sapiens
MPGRILYLVIEQTAELCLAGLFSHPQNGDKTYLMKLTLVLSESDIMKRKSPESWRHPSSLPGVSSRGVAASLTCMYRGTGFRALATECLTARNCLGHPDSSSDSLPCFIGQSSWP

SEQ ID NO: 781301 - protein, 77 aa, Homo sapiens
IILNSSHHTQHQAFKYQLMQHHHQQHHQPELQQLQTRLPLFHGDTFLNKDKKATQGPDLPLSPAESGLPLTHPVSLC

SEQ ID NO: 781302 - protein, 39 aa, Homo sapiens
GRYSSLQEVEFNLPLPTECELDLMNTLQIKEYQKEKSSN

SEQ ID NO: 781303 - protein, 58 aa, Homo sapiens
MALEAWEHRGPVCFEDLRQEAGRGAQGVSVASRTEGRTALLTVVCSGQAPERWGALHP

SEQ ID NO: 781304 - protein, 47 aa, Homo sapiens
LVQVRGPTPGASCHQGHLATRGILPAEKLRHSSEGPPMGHRRFPLSI

SEQ ID NO: 781305 - protein, 106 aa, Homo sapiens
FLGTPFAQALTVPDLELLTQWLLNPPASPGALASLQPTCHTVARVAFKDINVAMLIPCLLGPLLRTAQHMLNPGPSSSLYVNGNGLRSPPTPARRDLREAPISPTT

SEQ ID NO: 781306 - protein, 111 aa, Homo sapiens
FYSTEQRSSRELQTFHGTQQGQAWSWTQSQEDQTTQIMPSKKNPGVQPKMLINLYSFLSPPPVLGGEGVRLGGPSVSRAWENSSLFPHRGWDEGRQANIAVGDLGASCVRA

SEQ ID NO: 781307 - protein, 68 aa, Homo sapiens
ARQPCYCLAPHLHFCLLQQHFRFLFAGAAHYSPDERGGEREKMSFRPVPLTWQREAAILRLHFFFWIT

SEQ ID NO: 781308 - protein, 70 aa, Homo sapiens
EKEQVWGLRESYELNFGQVESEVGIQEEVACKELDRGSRSSRRFKQEIWFETMVIVAMGFGELALAERVS

SEQ ID NO: 781309 - protein, 109 aa, Homo sapiens
MERGSCALGGLVGASSFTDGGTPSLCCSLLSFQVGWVVSGASMASTRLVSGAMLGASRLPVPWEPCLPFWTSCLSSLGSELSLMVFWRHAQLVSRPRGIQTHQTHPLKT

SEQ ID NO: 781310 - protein, 104 aa, Homo sapiens
HVHESARSFDVHATGIHWPPATVVLPGGICSEGDPRSSLSALPRPHCHSKLRMSQSKLLWVGLQTGSPPDLLSRRSTTPRVYKPDPREISVTYCIHPGPARSPL

SEQ ID NO: 781311 - protein, 55 aa, Homo sapiens
VPCDPRDCQLEVTHVPARLHPAKLHLLPWAPRGNPFVRAHKHLPNPHSTPCVDCQ

SEQ ID NO: 781312 - protein, 66 aa, Homo sapiens
LSLPRTKKIIYQLMHVLRGTSEQETDPSSVGGMSVHVCLCVSRESLLKKVPPELPAAGKVLHQQRM

SEQ ID NO: 781313 - protein, 66 aa, Homo sapiens
LKKGGALGIKKLSISQEVLAIWVWQPQFCYQEMMYFIYISRNEYIFPNRKCKTLKKIYDVTLYLLS

SEQ ID NO: 781314 - protein, 46 aa, Homo sapiens
MTSTASTQLNYTAHPWGRALREVERGRQGPTFPSAGEQHLLEVRLV

SEQ ID NO: 781315 - protein, 113 aa, Homo sapiens [sequence omitted]

SEQ ID NO: 781316 - protein, 102 aa, Homo sapiens
SCRWSNGVSLLKRRLLRLRIFTHIHKYKDTHTQVPLTHQHTDNHSQTQRHTNLHTQVHTQTHYTKTHTHTHAHKDTCTHTHKQHTHQQSQQQVKLSLSPQYP

SEQ ID NO: 781317 - protein, 146 aa, Homo sapiens
ALFSPWGDAGHRVPLFLFSVRPGPGPPRMFPWAPACCDVGHGVVPQWATSQVVAPAVFLQSEPQQLHLGAGFSPVHGSVKDAHAVTDCSSLRQKFMVSPSAQAPSVTLGRDLLEESRMVPAHSGLSWWEGGMWPRVFSGVLAVQLR

SEQ ID NO: 781318 - protein, 49 aa, Homo sapiens
VVFGTLSANSSKEMRPRGSPSTVMSKNTGLTMADSTGLLVVAAKPLCPT

SEQ ID NO: 781319 - protein, 51 aa, Homo sapiens
MVILKQVEGMGDLRSSKAVGSFVGSPAGSSVPGLQVPGEGWGREAGGCVPA

SEQ ID NO: 781320 - protein, 140 aa, Homo sapiens
PFQALLCLWDYILCAGLREHEEGAICHTLEAEACTSAARLTVVGGGDGNCRSARVVEKLLQGFSGFACPAAPCLARGEGGATCGTLEAGACRWHGSAAHLAAVGGGDRDCSLTVVVVTRSSATACPLVTGSLHHPSWVAA

SEQ ID NO: 781321 - protein, 162 aa, Homo sapiens
PFQALLCLWDYILCAGLREHEEGAICHTLEAEACTSAARLTVVGGGDGNCRSARVVEKLLQGFSGFACPAAPCLARGEGGATCGTLEAGACRWHGSAAHLAAVGGGDRDCSLTVVNLEIICLEALSLSWDLKRRGSPNSQQSNSKWCYKLNHTWTRQSSEDP

SEQ ID NO: 781322 - protein, 130 aa, Homo sapiens
TVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQI

SEQ ID NO: 781323 - protein, 33 aa, Homo sapiens
AGRKPQMGKRSALSQGGTVTEAHGCDQRNKVFT

SEQ ID NO: 781324 - protein, 85 aa, Homo sapiens
HLFRVSQPSHAASCPGFGSSPRAAGGQRCNLKADRAWAVSESRGGSRLLVILVCLCRASPQWSWLWSGKAWTGWWICPLGPSSST

SEQ ID NO: 781325 - protein, 53 aa, Homo sapiens
GGRDLGASREAGKRVVWDKGRSRQTPAGRDSIGFPIQPEDLESCPASQDSSWH

SEQ ID NO: 781326 - protein, 94 aa, Homo sapiens
FATLSSCRLMSSGILLGGQPCISCHADDTAAAALCSAKGGTEIARRINHKALPQAAISQAQRGWAQRQPRQIILPLSLQTTLSSGMPLPTLPGD

SEQ ID NO: 781327 - protein, 36 aa, Homo sapiens
VTDLYLQLSVGLLQGTHLVQVGGQAVIEVLHGGLLT

SEQ ID NO: 781328 - protein, 110 aa, Homo sapiens
ASWAGRGRPSPGPQGGMTPLLWRKVEGKAERWCLQPPWTREELRCFFKTESCSVARLECNGVISAHCNLHLLDSSDSPASASQVAGITGTRKPPQPANFSIFSRDGVSPC

SEQ ID NO: 781329 - protein, 101 aa, Homo sapiens
AAAPWRPLKEPLRIRASRKGEKPARGAVLTVAGLPGALWNRLLLEQRAGDGPRRGGKRLRLPSLACGGAAGSAGHSCVGHSGLRLARLCVQETSRKYPKRE

SEQ ID NO: 781330 - protein, 101 aa, Homo sapiens; identical to SEQ ID NO: 781329

SEQ ID NO: 781331 - protein, 84 aa, Homo sapiens
WAQAICPSQPPKVLGLQEGFDALDPFIPILVSNYNPKEFESCIQYYLENNWLQHEKAPTEEGKKELLFLSNANPSLLERHCAYL

SEQ ID NO: 781332 - protein, 397 aa, Homo sapiens [sequence omitted]

SEQ ID NO: 781333 - protein, 85 aa, Homo sapiens
MRKSGSTQEEEPGPCTYGMAIMDLVMMEAILEVVAATMILGSTTISLRILDPCREGSVEAEALLPIPLESQILAMNHESEYDSPV

SEQ ID NO: 781334 - protein, 112 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVLKTGNGIGGSPEYKLLLAKGWG

SEQ ID NO: 781335 - protein, 364 aa, Homo sapiens
FTFLFLVHDIDDQHTPEFFVFKAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 781336 - protein, 418 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVLKTGNGIGGSPEYKLLLAKEVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 781337 - protein, 219 aa, Homo sapiens
MNALKNLQVQCARIERHILLRKIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 781338 - protein, 397 aa, Homo sapiens [sequence omitted]

SEQ ID NO: 781339 - protein, 397 aa, Homo sapiens [sequence omitted]

SEQ ID NO: 781340 - protein, 397 aa, Homo sapiens [sequence omitted]

SEQ ID NO: 781341 - protein, 397 aa, Homo sapiens [sequence omitted]

SEQ ID NO: 781342 - protein, 397 aa, Homo sapiens [sequence omitted]

SEQ ID NO: 781343 - protein, 397 aa, Homo sapiens [sequence omitted]

SEQ ID NO: 781344 - protein, 383 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKDSSFWISSVTQGTA

SEQ ID NO: 781345 - protein, 342 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKLLQKKGKKSCCS

SEQ ID NO: 781346 - protein, 358 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKVKSKENLFLLRLLSCLKKNIFINLCILT

SEQ ID NO: 781347 - protein, 317 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWVSAYDTSHISERNVLSF

SEQ ID NO: 781348 - protein, 209 aa, Homo sapiens [sequence omitted]

SEQ ID NO: 781349 - protein, 157 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDG

SEQ ID NO: 781350 - protein, 397 aa, Homo sapiens [sequence omitted]

SEQ ID NO: 781351 - protein, 211 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQGVLWEKWLNRA

SEQ ID NO: 781352 - protein, 370 aa, Homo sapiens [sequence omitted]

SEQ ID NO: 781353 - protein, 397 aa, Homo sapiens [sequence omitted]

SEQ ID NO: 781354 - protein, 317 aa, Homo sapiens; identical to SEQ ID NO: 781347

SEQ ID NO: 781355 - protein, 397 aa, Homo sapiens [sequence omitted]

SEQ ID NO: 781356 - protein, 397 aa, Homo sapiens [sequence omitted]

SEQ ID NO: 781357 - protein, 379 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKGSYQLSGSSQ

SEQ ID NO: 781358 - protein, 377 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEFESCIQYYLENNWLQHEKAPTEEGKKELLFLSNANPSLLERHCAYL

SEQ ID NO: 781359 - protein, 317 aa, Homo sapiens; identical to SEQ ID NO: 781347

SEQ ID NO: 781360 - protein, 316 aa, Homo sapiens
MLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKDEVERVITIMQNPRQYKIPDWFLNRQKDVKDGKYSQVLANGLDNKLPENLYATLEKIRPHKGLVTSGAFVSEANTPRPLAAVAAPGVCPKRNKSGGPVC

SEQ ID NO: 781361 - protein, 112 aa, Homo sapiens; identical to SEQ ID NO: 781334

SEQ ID NO: 781362 - protein, 75 aa, Homo sapiens
EMALHLRIFVVVISRGVWGPMEGGIKVLWCSDVSGSYFSTADLRAGWLHDAWLPDAARELEFPSCLSFSQGKEQT

SEQ ID NO: 781363 - protein, 75 aa, Homo sapiens
SCPPTDGLPPSVLPHPGQLVTPQPLGLALLGNGGQSRGAHLQPQGALRATWLLQVEVQPALQPRLGSQDSNLSTH

SEQ ID NO: 781364 - protein, 115 aa, Homo sapiens
ADWSIGGHRQAWKKHRLIGQKASVKFSLQVADSTWNGQLSPQASGHPWLKGRVSLETHPFLPRNLSASHCHQHAIHGTQAICTEGHPHAHAQLPSMPPASLPHSSLPEVQKGLRQ

SEQ ID NO: 781365 - protein, 53 aa, Homo sapiens
LVKLVCDILESLTASVEDTTSHSMSAGLFPVFSTRFLSTLHSGDFLSPVFLVT

SEQ ID NO: 781366 - protein, 838 aa, Homo sapiens
SAPTELPAMGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIVGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 781367 - protein, 71 aa, Homo sapiens
GGAERRQVAAAGRREEGQGFAVLLSKNIQSAGMTGMSHHAWSMNFLKRMYVYKNRFKGKALNGFFLWKMRL

SEQ ID NO: 781368 - protein, 264 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHR

SEQ ID NO: 781369 - protein, 70 aa, Homo sapiens
PLTISLKTVFREIVCASVCFLHSRVIIVGGNMPQSVTRKAHKGTCLRQHVASPMNYASSAYGQWRPPKNN

SEQ ID NO: 781370 - protein, 78 aa, Homo sapiens
KYEDKFGDFWGRNVLLFFKERTTRRALILLQSGKQIWELKLQEPFGYQEGGSLTTKTAPEEDVIKEIREKQSQVAGSF

SEQ ID NO: 781371 - protein, 120 aa, Homo sapiens
MSAPHCMALVRSLCLPGPHCVHSLLHATKHLPDVPAPPAPASSQGRRRRLPLLKGLFPMAPLRPLQETISPSQPRPFSPLPSPQALNGPATTLNSDLGQPSTGGAGGSVNSERNSLTECQ

SEQ ID NO: 781372 - protein, 179 aa, Homo sapiens
VTLAGSYGGLNPTRTHTCHVDPDASAWAPKSGSPHSSGTRVKTCCSIPSRLPQRAALVAPEFLEEAKSQQPLKWAGDALDPEDIRYQARQLTPTSEPQLQSRRGAPAVSDWTPQTRPAPPVAWILRPDPQAAKSGDGPRQQPLSFIHVDTECPAPGPRIQRDAQEERNLRPGGLCTLRP

SEQ ID NO: 781373 - protein, 127 aa, Homo sapiens
VLSLVIIPDAAPEDREVRSCQTCEPGILLAHWRLLCPSHLSLGLLGNRRDEKVKQTWAENEVWKKLCLASYVADSYCYGNKQQVKGWGRSHQYLPYSVQKGSGPEIARRTTKGVKEAEGCGFELYWS

SEQ ID NO: 781374 - protein, 75 aa, Homo sapiens
CWVTLRIPVRRRFSASLRRLSIRGFRLTPQRKCPGLAGISGDEFTPRCPGTAQVRWVLALTVCVRAHSLTTGRLD

SEQ ID NO: 781375 - protein, 69 aa, Homo sapiens
IYLMTEESAPQVQKLIYKSFYEHMCPGLLIMAENWKGMQLSIHRTTNKQTVLHSYNGPADTCSNVDQCQ

SEQ ID NO: 781376 - protein, 106 aa, Homo sapiens
SRLGTKVLSQEAFLNSSVRQTTSRAAPALLRPSLSRNSSHSFSDGRGPTPTTSLRVCLMTQTARVLGKPHQPAPYSAGNDGDLLGDGRRGRRWDKVPAPGSLRSIH

SEQ ID NO: 781377 - protein, 81 aa, Homo sapiens
PAIILKEVGMKAALQVSMNDGLSFISSSVIITTTHCSDGSILAIALLILFLLLALALLYWFWPLCCTVIIKEVPPPPASAS

SEQ ID NO: 781378 - protein, 109 aa, Homo sapiens
WVAPQLECGHPNSSGAILGLVRWQTAVTLRGIQHHSADMWWVRPCQWGPAACASCDPCSPTVCWDSRSQGPFSPSDICLALTVSVITTYGHRCFFLIIVSSRCHMCITL

SEQ ID NO: 781379 - protein, 275 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIGGGGGVRASRPGGGAGGLGRLLVPALPQSACGLELIQLTTEFKGSLKAPEATV

SEQ ID NO: 781380 - protein, 276 aa, Homo sapiens
VSFLECGRVLPCLTDLSTGQEEDAPLGVSRVSPVGSSAFAAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIGGGGGVRASRPGGGAGGLGRLLVPALPQSACGLELIQLTTEFKGSLKAPEATV

SEQ ID NO: 781381 - protein, 425 aa, Homo sapiens
MGRVQLFEISLSHGRVVYSPGEPLAGTVRVRLGAPLPFRAIRVTCIGSCGVSNKANDTAWVVEEGYFNSSLSLADKGKFGSQFPSGDPWGQPLEWGLSVLSSPFPRSASWIWHWPILSQGVGPDGFLIGAGWLKGPPPPCAGFGWALTPGTAVSPLPHSQTTLLFKPSSYPQSFTQATDLAAVALVTETGRPSVSWSAAVPTLILALWPPQATSGGDCPPLPPVSAGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIGGGGGVRASRPGGGAGGLGRLLVPALPQSACGLELIQLTTEFKGSLKAPEATV

SEQ ID NO: 781382 - protein, 53 aa, Homo sapiens
VICSISLPAAREAEVVRPAVRCCWCLCGHDLVRYHSASGGPSYQPCVLDSPVT

SEQ ID NO: 781383 - protein, 45 aa, Homo sapiens
MPVQCSEKGVAPSILTLTIITIIIATTIIVTITTIAITITIITTT

SEQ ID NO: 781384 - protein, 102 aa, Homo sapiens
MKPECHTVSHELVENVFPVSQPHYSKMQCPFTKPNLTDFFEHSTHWQWKVANSKMSRKAWYPMPQHWSIWCLSWPTMLELCKLASLQKYNPKNQLSSLPKQQ

SEQ ID NO: 781385 - protein, 37 aa, Homo sapiens
MEPSGRTDRYLLWACSYALSKFERSHSGHEGTFLLDL

SEQ ID NO: 781386 - protein, 74 aa, Homo sapiens
NVARSLGQRHLLLQLPPSSLSLGQNSRESLGLFPGMEAKTTVGGGLQSPATPQSPVKHEWAFTIRRRLQWSRSF

SEQ ID NO: 781387 - protein, 122 aa, Homo sapiens
YTVSIEPPTQASAMADTPPPAKLQHPPVDLKNSCASSEQGSMGVGPTEPGTGGNLLVCWLQRPWERCSIWAEAYHSCRYSHSRLPLARKGKSPNPLCFPGEAMPCPALAHPPWLHPLSNHSQ

SEQ ID NO: 781388 - protein, 62 aa, Homo sapiens
FPHMKSLSRNSWNLRLFQSLSVPTQSQPPFHTHPIDQSSFHASKGILTRTLALTVEAVFLKI

SEQ ID NO: 781389 - protein, 67 aa, Homo sapiens
YLSGGIGHYCLTFQEVKQNGTEKEIVSFLDQKVTGGPSKGSPKRVVVRKGIPEIQFREDNEELRESL

SEQ ID NO: 781390 - protein, 67 aa, Homo sapiens
AGTMQALIPLESGSGMTQTSGVSTETGDVVKDMGVNNQSKEGRCPWKDHEAAPWISEKPKKRGNEGK

SEQ ID NO: 781391 - protein, 39 aa, Homo sapiens
NTAWADRNRDNKQNSVMPLGLDLHLTAGTVLYRFLPHSP

SEQ ID NO: 781392 - protein, 175 aa, Homo sapiens
PILRGPLPPSILPGKPTSALAPGPVGLDKGSSSTTQPRGQRHMPHPSCPGVLSSHQLLQPWPATALSLDGPVRPAPHCSPWASCQSHQASISPHTLFSWGHLCTQRWVLFLGEAGPQLTLPRRGLGAWLGAPGPLHCGTERNPSSGHPRKGGSPKSSPGSVHLDSGSFQPRRTRR

SEQ ID NO: 781393 - protein, 67 aa, Homo sapiens
FRKRRNHVPVASPRLLASVRTHVALAPRRGYLRKHAPRQHAAWPCYPQPPLLLSLSSQVSAGLPGLA

SEQ ID NO: 781394 - protein, 96 aa, Homo sapiens
PHSHYTEREAPKAERVAPITLEVNGRVRILVAGGTPQCPPHQKNPSTLGQLSQLTEKPPPAQPHPIQANRKRGPRSRWDGEIRALVLPCAASQAGK

SEQ ID NO: 781395 - protein, 41 aa, Homo sapiens
MFCCRNANELDDRLLPQALLGGYVTYSRCVPHSLFPSPSCS

SEQ ID NO: 781396 - protein, 42 aa, Homo sapiens
SEGQRQPLDASIGPHRVLLLLVVQKHSSWHLHLLTCVLPLLQ

SEQ ID NO: 781397 - protein, 88 aa, Homo sapiens
PSSWQVKDNRVRQLPTREWTAWMMEADPDLSRCPEMVLQLSLSSATPRSKPVCIHKNSECLKEQQKRYFKVFSDRVVYTPESLCKPLA

SEQ ID NO: 781398 - protein, 131 aa, Homo sapiens
GPWHICHPHQPPEPRPPTHAPAGLGSEPCPESRAVFQDGKPMPMLPTYVLGWTQQGKTCAFQSQAAYGREVSCFPGQRQAQRLRISVHGPRGHVDPSRNAPRRPDLARGGVWLLVTHGPGPQNSGSLLTGS

SEQ ID NO: 781399 - protein, 47 aa, Homo sapiens
ILLSYDLYSLLILQLVIQIQFVYLYPKCLEPEEFQNLDGERLILEYL

SEQ ID NO: 781400 - protein, 109 aa, Homo sapiens
TSQRTSAPGQGYSRMQRRRLRGGPPLSSGCLGGQSLGNWEPLRAFEGHEMIRCAFREIIGWIVEDWRPRESVASENDSGTGDMKNREVEVIVWMFGAREQPSVLPLMPG

SEQ ID NO: 781401 - protein, 54 aa, Homo sapiens
SCRGWRRSGVHVCERTPLEHVSRESGRDHCPQPFKAHKPTTHLSWKQHVIPYAP

SEQ ID NO: 781402 - protein, 141 aa, Homo sapiens
CKQAYHSKVSCFVLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILA

SEQ ID NO: 781403 - protein, 150 aa, Homo sapiens
CHHLPEVAHKSSASAGAPSARLPLQPHSLGTRTKLPPSLCLPGPGRTRLTTEPFPGAPFCSDSCSPALCCVLLTPGRGERERGPSGKLPGRQGWVLPYRYSTCCAGNGRLLDGGPSPGMAGTPTPVLPTVCFQRTLAPASPHPHHALHLA

SEQ ID NO: 781404 - protein, 116 aa, Homo sapiens
PQAVVFDACLVIPCRDLQSQRQLASSEKYLCPWYSPHPQSDPCKIPYNWLPCHSWYDILWTTQSQGWTSSAGCTSLKPYIHFTKQNNSSNCQHLRCNLVHISITTSTSTNHIPTLS

SEQ ID NO: 781405 - protein, 117 aa, Homo sapiens
IIQPATQPLQGDALHGGVGPCSAHPRDDARRTARCSSSSCHDSGLGGAGPISPSLSRVMSGPHRRELAPAPAQLPGGGRETLMAVTVMMATGDGSTPQPQGTLRTRSHHGTIATRGP

SEQ ID NO: 781406 - protein, 32 aa, Homo sapiens
QFRDNNKGKHAFMKPDFLISYNITGTRLNIYC

SEQ ID NO: 781407 - protein, 132 aa, Homo sapiens
MSQASVGLPKGHHQAPGPKRKETARVLTSPEKTDDPGCQGACQVAPLPILPPAPSRFPVAVAYGGRGTGDEGRGLTRGELGHWPETGCSLAPLVALIHCVISTSHFASLVLFPTLCNVLLHSSLDDRARFSL

SEQ ID NO: 781408 - protein, 91 aa, Homo sapiens
GIQRLKGHLTLQRLLEMQGCFILGKQKILQNQTVSGIGGFLVSLTSRMKPRTLAVSVTALKVAFLESVSSDVQMCSEFLPSGGFVVSLAQE

SEQ ID NO: 781409 - protein, 98 aa, Homo sapiens
RDEKTFGTDCVEAVILLVTLLWEKKEAFHVGFSEELQYFPERSTEKLKVFEWEEEKQTTATSEDNTKHLVHSVYTRGAVNFLVEKELSLEKYLKKPLK

SEQ ID NO: 781410 - protein, 82 aa, Homo sapiens
MNGNGVSRVHGNGLHEASEFYYEAVEGAHNPGGLLLSPAAFINPAQYASVLEGRFKQLQGEARGPPVGTTVPGREGPGCGES

SEQ ID NO: 781411 - protein, 143 aa, Homo sapiens [sequence omitted]

SEQ ID NO: 781412 - protein, 34 aa, Homo sapiens
MNVRGKSSVSTPKTPSEWTKMSGQQVRFPALCTR

SEQ ID NO: 781413 - protein, 41 aa, Homo sapiens
RTCTHVYTHTRTGTHAQMHAYTGHVPSHTCKHTHRHSCRCT

SEQ ID NO: 781414 - protein, 76 aa, Homo sapiens
SFCDARALVGGAGGEPADCVWHWARGNTVHPGWARGSWERRASQVGSGLVGTPCIVGEHGEGLGGQGARGSAMHPG

SEQ ID NO: 781415 - protein, 103 aa, Homo sapiens [sequence omitted]

SEQ ID NO: 781416 - protein, 117 aa, Homo sapiens
PLGYKGTHCELWWQGPQACAPPACVVLPTGMLVDLAHVPALLAIMMWDPPQLSANHSLFSVYKSPSHQKRRAGEAALDREITGSSFQCPPSLSELWCLKQIRLPLNVSFCSSIQSGQ

SEQ ID NO: 781417 - protein, 107 aa, Homo sapiens
TIPVCIPFLHLLPRQETPSWSKRKPSEKFRDQPFYFGPGGLCGRANLLPFSHPPENYNFPSGALKPRDNVAFLYLSGCNAHLGNHWDLPRQTEVVFGCCLFIWTVIS

SEQ ID NO: 781418 - protein, 82 aa, Homo sapiens
MIPESSEGYMNIIPNTCHPTLNQWWRSGKKLEDGPKFLKDSVVACQGPLMLTWQAALPCSMGHLMVVTLPFKNKGSAGHGNS

SEQ ID NO: 781419 - protein, 102 aa, Homo sapiens
MKALTCLKFALTLYIFSFLVLALGALRATTSCQLVRYRRENEGLLGADVFPFHYHNAPKNPYCSCSIPRGSLGQKDISSEFLQQLKEERKLFPKLFRCSAFW

SEQ ID NO: 781420 - protein, 84 aa, Homo sapiens
LIPLLLSFLVSRCESPNKSQEDGLPGPPQTVLLGNTDEGPSALFKLLSTKGLASEGCLKAQLLPCIGPARTRIMLLVWFAGSDH

SEQ ID NO: 781421 - protein, 93 aa, Homo sapiens
GFQSPSVARRPSTTENCLERRVRAKQENMGIWAGVGVVAEIGDCFHRRLIKLVIILRKMKDKVFTVGEGSYKYSRGKNKDDPRGVELEFGILL

SEQ ID NO: 781422 - protein, 93 aa, Homo sapiens; identical to SEQ ID NO: 781421

SEQ ID NO: 781423 - protein, 120 aa, Homo sapiens
AHRNAHMACAGHRLTHTDSHLFVPCTPELQRQASRYTRSGLTWPRGPRCTQFIPGYSEHTCTHVKPLCVQRTNVHTYAYEAVLQPQLTAGHRAHIYTMAQRQGCTYTITVQGHLCAHTRV

SEQ ID NO: 781424 - protein, 146 aa, Homo sapiens
SDAVKKVGRKGVITVKDGKTLNDGLEIIESLKFDRGYVSPYFINTSKGQKCEFQEAYVLLSEKKISSVQSIVPALETASAHRKPLVIITEDVGGEALSTLVLNSLKIDFQVVAVKAPGFCDKEPAQRYGCYYCWCSVWRRGVDPTF

SEQ ID NO: 781425 - protein, 68 aa, Homo sapiens
LGPVPGAALMKHTFQGVCDPLALDYVRGQWGSCFLLFPPSISLLFEIAFFPKVCSALSFPKGVISSPS

SEQ ID NO: 781426 - protein, 74 aa, Homo sapiens
MPLFSSSGRPGPWEFCPRGLRAFKEKSHEVGGAAWAAGQGDPSPQGTKKERAYRVSPDPGDSGPGRLGAPQRPL

SEQ ID NO: 781427 - protein, 57 aa, Homo sapiens
MAPLLRALISLKPQVLTVPPRLYTIWRWPHLDQHGGHSALSSPLPHWSKPRALPAQS

SEQ ID NO: 781428 - protein, 135 aa, Homo sapiens
GREPPQPRARCSLRSRFVPRRGGTGTRGGGCGAGGRSLSMDVTVSELLELFLQSPLVTWVKTFGPFGSGSQDNLTMYMDLVDGIFLNQIMLQIDPRPTNQRINKHVNNDVNLRIQNLTILVRNIKTYYQDRPFFR

SEQ ID NO: 781429 - protein, 172 aa, Homo sapiens
GREPPQPRARCSLRSRFVPRRGGTGTRGGGCGAGGRSLSMDVTVSELLELFLQSPLVTWVKTFGPFGSGSQDNLTMYMDLVDGIFLNQIMLQIDPRPTNQRINKHVNNDVNLRIQNLTILVRNIKTYYQRWGDDYDEEGEEADEEGEEGGDEENDPDYDPKKDQNPTECKQQ

SEQ ID NO: 781430 - protein, 172 aa, Homo sapiens; identical to SEQ ID NO: 781429

SEQ ID NO: 781431 - protein, 161 aa, Homo sapiens
MGGAEWESEQTGVKTFGPFGSGSQDNLTMYMDLVDGIFLNQIMLQIDPRPTNQRINKHVNNDVNLRIQNLTILVRNIKTYYQDRPFFRELNFLRADTAFEFSHWLQTNPVEVDSEQDTPAGGPGTGCGCQAWPWKAITVGSSGSGTDSQQGEWVLGRSGRR

SEQ ID NO: 781432 - protein, 225 aa, Homo sapiens
GREPPQPRARCSLRSRFVPRRGGTGTRGGGCGAGGRSLSMDVTVSELLELFLQSPLVTWVKTFGPFGSGSQDNLTMYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVGAWPRGGLSCGLLLLWWPGGKTSL

SEQ ID NO: 781433 - protein, 46 aa, Homo sapiens
MPTSCSICIFSSGSQSAQAGLKLLTSNDPPTLAYQSAGITGVSHHA

SEQ ID NO: 781434 - protein, 72 aa, Homo sapiens
PAGERKKVWRTVHAYMILAGERKKVSRMVHAKMIPAGEGKKVSRTVHANMKPAGEGKENRFVHSNVSIHFGT

SEQ ID NO: 781435 - protein, 70 aa, Homo sapiens
DHMIISMDAEKAFDKNHTFIIKAFNKLGIEGNYLNIIKAIYEKPTTIMLTSPHLKTDSFSPKIRYKGKMP

SEQ ID NO: 781436 - protein, 148 aa, Homo sapiens
NSVMNMLSQRHLRMSLGKIWMQTQTSTQGEYHVKSGVMLPQAKELPEAKRSLEQILPQNLQRKHGLTDVFISDLWPPELKKKRTYKYQRYHLRLHSNGAAKVLLIGERLIGECRRMQQQVCQMWWSLLLLQLCILESPCSDHHHFSIG

SEQ ID NO: 781437 - protein, 102 aa, Homo sapiens
MPSLFLIFLEMGSCHVAQAGLKQSSHLALYWSSENMIPELVLFISLDTFSFLAPKCGYLHAQAGKHLISEVRFYYIPNLGLNCCSHGQFFTLLSLKKKETKF

SEQ ID NO: 781438 - protein, 115 aa, Homo sapiens
PLVSQAGVQGRDLSSLHLRLPGSSNSPASASAVSGITGTRHHIRLIFIFSVKTGFPHVDQAGLFGQAGLQLLVLEDPSYLSLPRCCGCRHEPPCLALVLSIHVGLSYCLVSFHLS

SEQ ID NO: 781439 - protein, 108 aa, Homo sapiens
MSKGRKRSVPAPGEGDRGNSFLSFFVLCGPPADWMVPSHNEGRSSLLSPLTHMPISSRNTLTDAPEGMFYRFSSLLFFFQTIVRLLFFFELEFHSVTQAGVQWRDLSS

SEQ ID NO: 781440 - protein, 108 aa, Homo sapiens
MICGSAREVRIKQPYSLPCPPLEQLLLGHWHWSPPKSTPSLYAVLGWKDPELNAGPHHELGGNLRIILHNYIDLPRFPLVLRMLVCVEAITLCGSSQGLQCYRDRMLS

SEQ ID NO: 781441 - protein, 139 aa, Homo sapiens
DGYEFLEILKQVARDNTDNPDLSILWIDPDDFPLLVAYWEKTFKIDLFRPQIGVVNVTDADSVWMEIPDDDDLPSSLFPLPLRQEQHHSANAFSNAAIPLSRDRRKIIPMLTVLTVTEQILFFAGPSRVMAVPEHGSLG

SEQ ID NO: 781442 - protein, 65 aa, Homo sapiens
MSLAYVRRSNNRNYFMLVEITTTVILEVGGVWSLNSKNADFEGGLLPDVCTHQNISFIKAWMPTV

SEQ ID NO: 781443 - protein, 35 aa, Homo sapiens
QTPALVPAGPGRLILGLQVACLDTSNVGSGLYSCW

SEQ ID NO: 781444 - protein, 74 aa, Homo sapiens
RGEENGVNGEKEQNTAEKTLELISVAPTTLTGPGHTGWRLVWFLQRLKAAHSHLSLETEADKKAEVGILSNRTK

SEQ ID NO: 781445 - protein, 52 aa, Homo sapiens
MRLKLLGHHNVGKTSACHPPGGNEELIAGLIALTKPQAVRFCTIHVSIHPII

SEQ ID NO: 781446 - protein, 133 aa, Homo sapiens [sequence omitted]

SEQ ID NO: 781447 - protein, 115 aa, Homo sapiens
PGTEHRRHLCLHSPSRALLRLCDATLISQTRTLRVKAVSHIPRQGCEPIPCLPASLLPPSRPPLSGAWNEHSGVVRTFLDLPIKGVQSKYKVTSGATKATTVAITYEPLRPQINT

SEQ ID NO: 781448 - protein, 84 aa, Homo sapiens
VLVGLAIPAPKVLHGFHDIHALFPLAKDHMVAIQPLNLGSADEKLGTICVGSSIFHEQDARTCMLQDEVLIIKFLPIVGIAINY

SEQ ID NO: 781449 - protein, 136 aa, Homo sapiens
RESATHNSISHLLLPLPSQHSVANSHLHIPSTQGRKETGNVAYDCTPTGSETHTGVPPHPGVKAPSGQSTRWQRGAAVTTPNSEVRGTDGHWEPSQPGMCSGTLAHCPWRSCRLTSPFQNSFTCWAQWLMPVIPGL

SEQ ID NO: 781450 - protein, 73 aa, Homo sapiens
NGHVRKKSMSEHMCNCESIMKSCEGNSLMKERKEPKMAAVLNPADSETIGTINRIREVCVRACVHVCARACAR

SEQ ID NO: 781451 - protein, 280 aa, Homo sapiens
MCSAFHRAESGTELLARLEGRSSLKEIEPNLFADEDSPVHGDILEFHGPEGTGKTEMLYHLTARCILPKSEGGLEVEVLFIDTDYHFDMLRLVTILEHRLSQSSEEIIKYCLGRFFLVYCSSSTHLLLTLYSLESMFCSHPSLCLLILDSLSAFYWIDRVNGGESVNLQESTLRKCSQCLEKLVNDYRLVLFATTQTIMQKASSSSEEPSHASRRLCDVDIDYRPYLCKAWQQLVKHRMFFSKQDDSQSSNQFSLVSRCLKSNSLKKHFFIIGESGVEFC

SEQ ID NO: 781452 - protein, 280 aa, Homo sapiens; identical to SEQ ID NO: 781451

SEQ ID NO: 781453 - protein, 280 aa, Homo sapiens; identical to SEQ ID NO: 781451

SEQ ID NO: 781454 - protein, 110 aa, Homo sapiens
MFYKDMFSALQFSSGGNQTSQVVNTGVCPTCHHQVATGLMGDWEWEGKEEALLLWNLITGNPLPPGAQNLITGNPFPPGAQNLITGNALPPEAQNLITGNPLPPGAQDGF

SEQ ID NO: 781455 - protein, 56 aa, Homo sapiens
MRLAEKQVNREWICREVGATSGYKEKCDPKPSKEDTQASSQPGTGRSSVLLKWSGG

SEQ ID NO: 781456 - protein, 172 aa, Homo sapiens
SKSPTLTAPPAAVHAGNRSSFAKADGGALWGCDQSPASQCTCRCPLQPLASFRWLSLEGCASWAGVWCPEHADCPWSGGQDCFSLKGFHICTGALADGSLWQSSPGGFPVRRHLTVSSGSGECSPAGSTLEPGSAGRGGVGFPWWMRGAEGLGGSMCPQGQHFAFLGRLEDD

SEQ ID NO: 781457 - protein, 86 aa, Homo sapiens
TLGAYMVLGACWCHHENTAHIYSSCGVQDVTMWYCQYGTLHSCVYTHMHRHTCTGTCTHTDAHTDMDTDIHTDMDRYTDTHTEGAY

SEQ ID NO: 781458 - protein, 141 aa, Homo sapiens
PKPGDLFLPTSHGLPTPQCHSVQPRKLSSLGLSLSPSPRGACEATLTPAGPRPEVWPREALLLGLGVLHGGTILGQKTPISARRWGGLAFPLPFQHTASPGGQPQGPISFSCSSQRNTEKPVGCALGFGGDWRGGGAELMG

SEQ ID NO: 781459 - protein, 40 aa, Homo sapiens
ARITAVSHFAQPASCVLSTYCLYPKPNDLSAQGSSELKGK

SEQ ID NO: 781460 - protein, 141 aa, Homo sapiens
ASQFRVRERSPLGRARGLPEWLLCSQPDSCAAGCPPSPTGPEWGLGLGWRQLSQLQGHQGWGRQLCPMQALASAAHGTRCSQGGFLEEGSLVHTLFHEPYHLSVPGSELGDPRVPKRAPSQTLPSESCSWPGERIEEQSQT

SEQ ID NO: 781461 - protein, 61 aa, Homo sapiens
LGTGLYLLKTCGKKKKKMMNIGRGRELQENHGVDDGVNQYEDLRQQVFPKGKDKVRAGALP

SEQ ID NO: 781462 - protein, 123 aa, Homo sapiens
MPSPGLWVLLDSVTWEACSSPPVSGIFRDLVSTLQTSSLCVWSPNYPNKGKNPVIQGPWVGTSLIPYLGIAPPGSASRGGVGRDWLPAPMTVRRNGEGHPPPTALVLSLPPASPRRSLVSCTL

SEQ ID NO: 781463 - protein, 83 aa, Homo sapiens
AHFAQNLSLLTPTPPFSNLLGFFRRNVVGLGNPQNRNPPSSPPPLVYNHSRLQPQTPGARKALPHPPGNSASLHMRTHPAPGS

SEQ ID NO: 781464 - protein, 164 aa, Homo sapiens
ETRYIWAGMRGADRLPPEIPKCTQIPNSLELFSRALWQERGARNTSSWFRAGGRRAARSPATFALRRLGEPGGCRGESSAPTGNIGVPVAKATRLASEGLLCEHRRRVHFFESENSSELGLYQSLSRPLGRLFVYWLLREKSLKIFNQPQTWRGRKSRNLPKQK

SEQ ID NO: 781465 - protein, 113 aa, Homo sapiens
CLPRACVEQHSARDAWEVDENSIQPEMLGKWMMSTILRITCDAYFPGNRNEVGPGHLLSLLSVLQKEGSGAGAGGPGASQAAGQGERCRWQDPPGTRERHMRELLRYGVRQQG

SEQ ID NO: 781466 - protein, 45 aa, Homo sapiens
MSSIGKFQGQRYKGGVEYRDKATVSHTSGHKSTQATEQDAAIEEY

SEQ ID NO: 781467 - protein, 104 aa, Homo sapiens
MGKLHFRLEDTLSQLPLLDHFPKLCSKHPRVDAPKAAAPPLIPLSLLLISLSDKNKHNPSFKHLFHWSPLRAHLEDVAPLEGTWWAVVSPSTMPWISWCTSWLS

SEQ ID NO: 781468 - protein, 105 aa, Homo sapiens
TGSVSYGRVSGVSARTFISKGQNLGHASLNNKENVLPLLTEKSRKIQVWLDPGTPITSPGLSPSPSVSSVSSMLASFPGEPSSHCGPPQLQTTSCPLSPVERDPL

SEQ ID NO: 781469 - protein, 258 aa, Homo sapiens
MGRFMLKYTQTLETSLTAFLTFLNMVGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENGDPTSRQLLFCWRRLCCNHLGMRMGSGMMFPWHYQFSHYTWQKRDTVLVDKPLWLNAQNLEDETGFEINPD

SEQ ID NO: 781470 - protein, 56 aa, Homo sapiens
MQCPGMPGPLSMVSPSPPKSKLIHKAPGCIQACHLRPPSSASELMIWLREHRQVLP

SEQ ID NO: 781471 - protein, 91 aa, Homo sapiens
TLGCCSRSQSEFAGAWLEPQRRLSSREQTEGSGCVLVNDPQAQHARLPTILCALFTWTCRGLSGLYSVCYETSQPHAEASGRAWILIMLLT

SEQ ID NO: 781472 - protein, 66 aa, Homo sapiens
PEDTLGQRLENNTRKNGQKFFRYKRHPRPQAQLATASANIPFPPTLQIGKATRTPKSFTNSGGKVS

SEQ ID NO: 781473 - protein, 107 aa, Homo sapiens
FPNRARLLPPPPGRHQGVPQGLLWAVVASASGGAGQLQHARSPLSLICSREKHGSENRLRELLRTLQGQEQYRALQGQGHKPSGLPKTDCLGSNPSSAISSRPWASP

SEQ ID NO: 781474 - protein, 54 aa, Homo sapiens
TLGMEHGFTSTILKTKHNQSNGYHEVEVVHATATVDQSGVRSKGHGNSLWGMLK

SEQ ID NO: 781475 - protein, 106 aa, Homo sapiens
CISSQVAGTTGVCHLAWLIFVFLVEMEFHRIGQAGLVLADSCVWALCFGREAVICGFPSPFFLPKGDRFPSESSKDVGSRVSNPPPYPLILTPPRAGSKSLGFQSL

SEQ ID NO: 781476 - protein, 108 aa, Homo sapiens
PRWQEFAGRNARGEEQHRQTLETCRRSPSSIRLKYQPAHWYNDLKLRKNHQKGLEVPRNGTYSPLARTENLMTHKPCGRSTKWVLPYLWGLTGPKMRTAWVLPNTFKK

SEQ ID NO: 781477 - protein, 46 aa, Homo sapiens
MLMPHTQLPLPWGKLLPNSQAQRERKKGQWMRRGCDEGSFLKTHKV

SEQ ID NO: 781478 - protein, 352 aa, Homo sapiens
RRAKTLTASRSQAPVFTAESMLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 781479 - protein, 287 aa, Homo sapiens
RRAKTLTASRSQAPVFTAESMLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRGRFPFFLLVSSPRFQ

SEQ ID NO: 781480 - protein, 241 aa, Homo sapiens
RRAKTLTASRSQAPVFTAESMLWLFQSLLFVFCFGPGQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 781481 - protein, 79 aa, Homo sapiens
DLEDLSVILQLCYLHSNCSSLPSTMIVRPPLPCGTVTPLNLFCPLPSLGYVFISSMKTDEYIGDLKARFPVFYDKAIAK

SEQ ID NO: 781482 - protein, 120 aa, Homo sapiens
LQAHRGSALVFYDFFHPHLSPIFNEHIPRCHHGHHHHHRPLHGTTTVTSTITFTSAISIISTTITSTITSPPPPSPPPPPSPPLLHSTSITTITSTFTSTSTTTITTSSTSTSARPKQAR

SEQ ID NO: 781483 - protein, 138 aa, Homo sapiens
MEETHYLISNNKVIVTKAARYWYKNRHIDQWNRIENPEINPNTFSHLIFDKTNKNIKWGMDTLFNKWCWDNWLATCRRTVDPHLSLYTKINSRWINYLNLRPETIKILEENFGKTLLDTVVARISRPKTQKQMQQKQR

SEQ ID NO: 781484 - protein, 93 aa, Homo sapiens
IPLDLVYPFLMQGCVLICLRGPTVQHNSWPGGKAGRLSGPEAPGFISMTEVRQRRSILWMGKLTFHMLPAWGPSCFQKPYLLRPPLPQKMSWG

SEQ ID NO: 781485 - protein, 133 aa, Homo sapiens
LHPQAQGETFSGISLPDQEGFFPKETRKSHYLSHKRRLRTAITPGQTCAQDNAFLIQAPKRIICKLISVHSFSQIIICCPVKRTVYIPYLPLPCEIGYITFCVALGYWVIFLLLFIPRCYARQNFNVFSPVDS

SEQ ID NO: 781486 - protein, 148 aa, Homo sapiens
ESVRILENVLDSGQGTVRFPEREPGLSRSWAPPLLGSAGIPVWTSFEQEAQQGLGLLLLPEKYKHLLESYRYLMKARRTQGAALKGGHQSYPLTSGAAFEQRPQGVSEGERPSHRNHGFPEIVGATNHRPPQCAHSSLPCAIRHRNHY

SEQ ID NO: 781487 - protein, 90 aa, Homo sapiens
SDRRTRAGDGGDPCSELEEEEELGSGSEDAPRKIMEQSRKEAQKAASQTLSFYPLKEGKGSFHFLLLLGMWADKHLTPGTPALTIVYIPH

SEQ ID NO: 781488 - protein, 107 aa, Homo sapiens
MQPRPTNAKSLPQNKLSSWKKLEESPNHLSSDSRTPELYQDKTVQLSLFCTGVPPCEVIRETSVLPNPPHIHSLPLKHLLLYKLETEAPRKQLERNVEKLMIVRFSK

SEQ ID NO: 781489 - protein, 44 aa, Homo sapiens
MGPHEGGCLAWWPLVGTCGTHRSFPTRILWAAWVHLHRIMGGSR

SEQ ID NO: 781490 - protein, 39 aa, Homo sapiens
MLIHAGHAHHRVMSMQGILWKDEECVLHKNAPTSTQLID

SEQ ID NO: 781491 - protein, 326 aa, Homo sapiens
LLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQA

SEQ ID NO: 781492 - protein, 133 aa, Homo sapiens
RSGGQARHPSQLEDPALLQPAGAVTPGLVLLEVPALPLAGGAQPLPQGPHRQHAWQIQEEMAQDETWHTQAPESVGLALFHCLVSAEILCLWPVPAMWKPEGVCHAPRFGHCCVKGPVFRPLLCHLSTGARSP

SEQ ID NO: 781493 - protein, 174 aa, Homo sapiens
MSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIM

SEQ ID NO: 781494 - protein, 103 aa, Homo sapiens
MERQSRVMSEKDEYQFQHQGAVELLVFNFLLILTILTIWLFKNHRFRFLHETGGAMVYDKPPKFAMSREQMSQSCSHTAHNASLLTDAGPLSCGESRASCLFL

SEQ ID NO: 781495 - protein, 72 aa, Homo sapiens
TRGSRQQTTAVVHLNLLFVCSFVCFETVWPCRPGWSAMARSRFTAASTSRAQAILPPQPPEHLGPQVSTRSH

SEQ ID NO: 781496 - protein, 149 aa, Homo sapiens
IDDEPTVMGEPFTVNPALTPAKDKKKKDKKKKESSKELESPLTPGKVCRAEEGKSPFRESSGDGMKMEGLLNGSSDPHQSRLASIKAEADKIYSFTGNAPSPSIGGSSRLENTTPTQPLTPLHVVTQNGAEASSVERTAVRSTEPRVCG

SEQ ID NO: 781497 - protein, 136 aa, Homo sapiens
LPSATALSRRECPLTPGAIPALFTLTGLALLERPASRAHPAVDTSPPLAGSAPASGGQPLWTVPILRPFWRNGIHLTDSKGFFPSPFALVNRRTSSVLLASGLQGLRSLTLDVWPELDFIKILCLGLLTTPYSPLP

SEQ ID NO: 781498 - protein, 136 aa, Homo sapiens [sequence omitted]

SEQ ID NO: 781499 - protein, 33 aa, Homo sapiens
MFVLENLYWHMESSSTAKKEISVSPEKQRSHNP

SEQ ID NO: 781500 - protein, 132 aa, Homo sapiens [sequence omitted]

SEQ ID NO: 781501 - protein, 75 aa, Homo sapiens
MHSRRHLKGRSIRNQNAEAEVSASPLFHVMLIRGACQRVQICTQVTRLQRHPAYSAAPPHLASLASLLSRPQTTL

SEQ ID NO: 781502 - protein, 98 aa, Homo sapiens
PQDIYNQLKIEPRNRHSPVACSTKDTFMTELLNRVDKKAAPQTESGSSNASCRNVLKGSSQGSCLIGSSISTQGNHKKNMKIKADMEVPKDSLNPTAR

SEQ ID NO: 781503 - protein, 93 aa, Homo sapiens
EDEDDAVADSVFQSHIIESNCQMRTLDSGIGTFPLPDSGNRSTGRYLCQPDSPEDAEPLLPLQSALSAVSSMRAQTLEREVPSSTDGQRPADS

SEQ ID NO: 781504 - protein, 121 aa, Homo sapiens
TSAFSAPGSWVEKARGGWIPGVSAARQARVPARPVCEERPPLRVALTLGLLCRPGQACEPRQHSSPMGRKAGPGMSQAVVSVTRAVSVAPTLHPTSTSGCGTGCEGAEARKDCRALSQRCA

SEQ ID NO: 781505 - protein, 146 aa, Homo sapiens
SGPHAVVRVTPTQLPSACARRARRTAYAGRSGFPFPHVLSVRGLRTTHPGARAPGLPWSAPRFRLTHVCGGGGDCVAPHPGGGENGLSGGRGGRRARDRMPKPGGFGTRIAGNRGLFCFVFFSSNEGFGNSKMVQCKERIWFHQQE

SEQ ID NO: 781506 - protein, 107 aa, Homo sapiens
SGGPGGLTSAAPAGGDKKVIATKVLGTVKWFSVRNGYGFINRNDTKEDVFVHQTAIKKNNPRKYLRSVGDGETVEFDVVEGEKGAEAANVTGPGGVPVQGSNICSRP

SEQ ID NO: 781507 - protein, 42 aa, Homo sapiens
SWKPVQKVEIGQKRASEDTTSGSPPKKSSAGPKRDARQIYNP

SEQ ID NO: 781508 - protein, 116 aa, Homo sapiens
RDTVPFDLHRDLMGKRGQKETDPIKFGALTKVAQPGIQQGPLIPRWSFQPEYMAPLPAECAVKASDVPKVSLQQSKVIITSGFSKSQSRDHGEGWCIFRYTSSSQFKGPCRTGHMS

SEQ ID NO: 781509 - protein, 236 aa, Homo sapiens
GHWRRCSPDPGPPGPGCPPAFRNWPRGRPRGWSCREQTGRSAAHLSAPGPSRPPGRGWYFSAWGQGEPSDLRKRLRGPCWGRDGEKIPQAPGAPASPPPPGLPPARPLRGRGGPAFRPGRGGAAGGEAGAPSLGPRPRTHTCAARTRVRDPRAPAAGAGRSLGCLLPRPGRGPCAPAVWLDQGAACLPDRSDGSHLSGQNPLSHHPLPPGPWGADPHPPESVGIPILTWEVRGEPG

SEQ ID NO: 781510 - protein, 467 aa, Homo sapiens
MADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 781511 - protein, 115 aa, Homo sapiens
QVSGSADVHLSLKTEKKKSPSLKVVRQKEFSFIKPLGSSSDLSKAGIIPTSKSHVVAFLLQLFPLLWLYYLVYPYACVLVQVCQRNNQWDVCTWKEVYYKELAHMFMGVDKSQDL

SEQ ID NO: 781512 - protein, 73 aa, Homo sapiens
TVSQSFWIALGHASTLSQSSRQKRGFTIGYIHVEQRLPPSSISLPFEERGMRREERERSSSAVSLAYQKQRRT

SEQ ID NO: 781513 - protein, 117 aa, Homo sapiens
VQGCDLGSLQVPPPGFMPFSCLSLPSSWDYRRPAPRLIFCVCVCVFLVEMGFHRVSQDGLNLLTSGSACFGLPKSWNYRREPPRPAISYYYYFSICLSPSSTKGKLLAALLITTPLT

SEQ ID NO: 781514 - protein, 66 aa, Homo sapiens
LYRKPALLPPRAPSPLLAPSGNVYFSSSPVSNDVKTEVFFWSGQHYSIMTKSPGAACTGSQVNYWS

SEQ ID NO: 781515 - protein, 76 aa, Homo sapiens
RESPPLSVKGQTAACSVLGARWSLLQRLGSGSAVAAHRQLVPMSHTHKPRRGPSGPGPHCADLSYSTQEVLCKHQR

SEQ ID NO: 781516 - protein, 37 aa, Homo sapiens
MLRSNFSSSFTGACLTTAHTWLLIIRSGALYEGPTAT

SEQ ID NO: 781517 - protein, 69 aa, Homo sapiens
MKPLKFPQSSPFPHDPALVEPSPGVLGSCHGCALGLLPPGFNLPSFVSQRYIPKKQIGPYSSLLETLHA

SEQ ID NO: 781518 - protein, 100 aa, Homo sapiens
CPDSSSHHCDKLARTQVNPDLFPGRTHVPCCFSEPPRGCLLVVPLTGQIPPDSSSCLHSSPHHLGFPWVALCPLSSALGGCKVNGFLLFGFSAFPSPVCN

SEQ ID NO: 781519 - protein, 108 aa, Homo sapiens
SGAGDREAGTEGAAPGEEEDRDMKMAENDREGSMHKAARALGLGTSVQPLSPNPSPSPGQAPSALQEPPGGQPKSNTPSASTPLPSFQATREPTCAPREKQPRKMSPS

SEQ ID NO: 781520 - protein, 205 aa, Homo sapiens
MVTLPALTLGYFRTDEPDLSPTFISQFLIISTIFLCSTPALCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPLSSRIPNLL

SEQ ID NO: 781521 - protein, 49 aa, Homo sapiens
MASLGVVWEEGSWGFEGTCTFSPVLGAGDSSLPTAPSAHPQCYVAMAPR

SEQ ID NO: 781522 - protein, 142 aa, Homo sapiens
LRNLPGPIWAWPFQAVPAPQEDARLLPRIHEVRRMGPSINSGPRGGQQWPRRKGGGRFQRWPRPGMQRREALKASESKGYLRGLEGCRDRTSWRSWARWLLREGTENQGTQQSLLFPSHLASEEREGIKAGRVKRNEGPEGK

SEQ ID NO: 781523 - protein, 171 aa, Homo sapiens
MRCHNLKDYTIEIVAVDSGNPPLSSTNSLKVQVVDVNDNAPVFTQSVTEVAFPENNKPGEVIAEITAMMLTLALMLSWFTLWSLSRLLKGLFTISPETGEIQVKTSLDREQRESYESKVVAADRGSPSLQGTATVLVKVLDCNDNDPKFMLSGYNFSVMENMPALSPVGMG

SEQ ID NO: 781524 - protein, 115 aa, Homo sapiens
TRDPHTTAFQKPPSTYHVTGDPQTAAFQKPPSTHHVTRDPQTTAFQKPPSTYHVTGDSQAAASQKPPEESRASSEDRSLALSLLVFLRQGLCLSPRLENSGVITAHCSLDLLRLR

SEQ ID NO: 781525 - protein, 144 aa, Homo sapiens
LGDEEWTSLARAVGFTFKSKDMNYRAVEGRALGTLYREDGFSHGAYTRWALGTLYREDGFSRAYTRWALGTLQGGRLQSCIHTMGSGNTLQGGRLQSCIHTMGSGHTLQGGRLQSCIHTMGSGNTTGRTASSWCIHTMGSGNTT

SEQ ID NO: 781526 - protein, 73 aa, Homo sapiens
EHEWLLGWQHTALWQKGSDMLWSLPLFFKNLIWPPLYEEDKSDKLEGMSEHHLLLQQLLLSNSYVVLQCQHYI

SEQ ID NO: 781527 - protein, 106 aa, Homo sapiens [sequence omitted]

SEQ ID NO: 781528 - protein, 65 aa, Homo sapiens
EAGEGRSSCRFTDGKEPLDPPFNSPRDKFKLSRSLPFPATSTQRQGGDSKAQGHIQKLKEALSAL

SEQ ID NO: 781529 - protein, 371 aa, Homo sapiens
MEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 781530 - protein, 371 aa, Homo sapiens; identical to SEQ ID NO: 781529

SEQ ID NO: 781531 - protein, 371 aa, Homo sapiens; identical to SEQ ID NO: 781529

SEQ ID NO: 781532 - protein, 77 aa, Homo sapiens
GVHLANRAQDSHQKQTSGLLREWGRVWVQGCRVSGSESLVLWGLWIPENCLSPASGCARTTIPHPSALCRHFSFPSC

SEQ ID NO: 781533 - protein, 719 aa, Homo sapiens
MGEKNGDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 781534 - protein, 676 aa, Homo sapiens
MGEKNGDAKTFWMELEDDGKVDFIFEQVQNVLQSLKQKIKDGSATNKEYIQAMILVNEATIINSSTSIKDPMPVTQKEQENKSNAFPSTSCENSFPEDCTFLTTGNKEILSLEDKVVDFREKDSSSNLSYQSHDCSGACLMKMPLNLKGENPLQLANQMSLPKTTCKDKLSFFSTPHNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 781535 - protein, 266 aa, Homo sapiens
MLLTDWDIAKMNRLSIITGIIRNLSSIQVYIARAQANVLEGNQPFFNTIGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 781536 - protein, 526 aa, Homo sapiens
MGEKNGDAKTFWMELEDDGKVDFIFEQVQNVLQSLKQKIKDGSATNKDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQSRLCFFCECLPLLPVSLSLAQYL

SEQ ID NO: 781537 - protein, 371 aa, Homo sapiens
MGEKNGDAKTFWMELEDDGKVDFIFEQVQNVLQSLKQKIKDGSATNKDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSDPHSTHPA

SEQ ID NO: 781538 - protein, 685 aa, Homo sapiens
MGEKNGDAKTFWMELEDDGKVDFIFEQVQNVLQSLKQKIKDGSATNKDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 781539 - protein, 707 aa, Homo sapiens [sequence omitted]

SEQ ID NO: 781540 - protein, 647 aa, Homo sapiens
MGEKNGDAKTFWMELEDDGKVDFIFEQVQNVLQSLKQKIKDGSATNKDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNSLTLSPVAQSQLTATSASGVQAILMPRPPE

SEQ ID NO: 781541 - protein, 73 aa, Homo sapiens
DESPSILKMLVETLKPGKQRNKGGQGIEEMRPRVERSYLNLPIVKQESVLPWEWRGWGGVSSQPFGCGQGWVM

SEQ ID NO: 781542 - protein, 62 aa, Homo sapiens
SGPLGVFHVLPRPPMPFCVLLVCTVPVAQSSDPDDLIQSHGSFCADSSQTSLFSPRTADSAL

SEQ ID NO: 781543 - protein, 122 aa, Homo sapiens
RPCPPLGLAVAPGLASNFSEQEPPVCQKELVVPSSPSLWVSQDPGRRWCAGPGGVKGDRRGGDYCHFTGHLTWAQSLGFMGEPMNLPEWFKPKGFCTCTCQWESMFFTFSKGARDPKAVWHS

SEQ ID NO: 781544 - protein, 136 aa, Homo sapiens
GTQVHLCSGMPSFLVRGRSLSGMEVRGGSIPEGTPVQVLAEVCYLTLSPGRGFTTVKLFFFSPLRYWKDFRLWKKSMVHSPQGRSGELQCSSSFKPQQQVLFGILFHGIFVSFLPLTNLLNHLFILEWTHASLSFK

SEQ ID NO: 781545 - protein, 80 aa, Homo sapiens
LRVERGAGGTGCRSTGANTALRSWEAGVGLRAGPVAATAADSHFAHKTPRCQQTGVACSPQSPWESCLESKLCYMQRAGD

SEQ ID NO: 781546 - protein, 75 aa, Homo sapiens
APAAAPSCSAGTGTWTRPLVARDARRSAPNDTAASEVGAAVRALEVFFSPGPRELLATTPSKIELSALRLVVRKF

SEQ ID NO: 781547 - protein, 97 aa, Homo sapiens
LTLEKSVSPTKMWAQLLLGMLALSPAIAEELPNYLVTLPARLNFPSVQKVCLDLSPGYSDVKFTVTLETKDKTQKLLEYSGLKKRHLHCISFLVSTD

SEQ ID NO: 781548 - protein, 139 aa, Homo sapiens
MGSQQCGRPPQNSSRAPGWTHESRRVMGISLAILASRYNDLSDSLRSKGSFKGCHPRLPGGPRRDVRRTQGHRCFLNVTVTAASAPLWKELAPLMREFLLMAFPSLLFKKLPFILTFFKFYFFEPGSCSVAHAGVQLQS

SEQ ID NO: 781549 - protein, 131 aa, Homo sapiens
MESPSVAQPGVQWRDLSSLQPLPPRFKQLSCLSLPSSWDYRREPLRLACVALETTPHHGIPGDIPADSRDGGTTNNSLFCSNTHTHTHTHTALQISREPSHWPLCVPLLPISAIYFPMCTSPGGTRTTVMI

SEQ ID NO: 781550 - protein, 122 aa, Homo sapiens
RKKIHRRVLKKNPLKNLRIMLKLNPYAKTMRRNTILRQARNHKLRVDKAAAAAAALQAKSDEKAAVAGKKPVVGKKGKKAAVGVKKQKKPLVGKKAAATKKPAPEKKPAEKKPTTEEKKPAA

SEQ ID NO: 781551 - protein, 81 aa, Homo sapiens
LKAWNDIKKVYASQRMAGKGKMRNRRRIQRRGPCIIYNEDNGIIKAFRNPGITLLNVSKLNILKLGGHVGRFCIWIVFFFS

SEQ ID NO: 781552 - protein, 122 aa, Homo sapiens; identical to SEQ ID NO: 781550

SEQ ID NO: 781553 - protein, 104 aa, Homo sapiens
DWVFHDSRQCHSILTFQIRKSGFIFNTSQPLIIHMKSAAILRCYPLLLLQTLLTPPPTSYFAVSPFPPSLLLFPMYCSLPLSNICSHNFLPEGHQVPFSMTNQV
